United States Patent
Kley et al.

(10) Patent No.: US 12,091,463 B2
(45) Date of Patent: Sep. 17, 2024

(54) Clec9A BINDING AGENTS COMPRISING A RECOMBINANT HEAVY-CHAIN ONLY ANTIBODY (VHH)

(71) Applicants: Orionis Biosciences Inc., Newton, MA (US); Orionis Biosciences BV, Ghent (BE)

(72) Inventors: Nikolai Kley, Newton, MA (US); Jan Tavernier, Balegem (BE); Lennart Zabeau, Zwijnaarde (BE); Erik Depla, Zwijnaarde (BE)

(73) Assignees: Orionis Biosciences, Inc., Newton, MA (US); Orionis Biosciences BV, Ghent (BE)

( * ) Notice: Subject to any disclaimer, the term of this patent is extended or adjusted under 35 U.S.C. 154(b) by 222 days.

(21) Appl. No.: 16/636,250

(22) PCT Filed: Aug. 8, 2018

(86) PCT No.: PCT/US2018/045742
§ 371 (c)(1),
(2) Date: Oct. 16, 2020

(87) PCT Pub. No.: WO2019/032662
PCT Pub. Date: Feb. 14, 2019

(65) Prior Publication Data
US 2021/0024637 A1    Jan. 28, 2021

Related U.S. Application Data

(60) Provisional application No. 62/542,944, filed on Aug. 9, 2017.

(51) Int. Cl.
| | |
|---|---|
| *C07K 16/18* | (2006.01) |
| *A61K 38/17* | (2006.01) |
| *A61K 38/21* | (2006.01) |
| *A61K 39/395* | (2006.01) |
| *A61K 39/40* | (2006.01) |
| *A61K 39/42* | (2006.01) |
| *A61P 25/00* | (2006.01) |
| *C07K 14/47* | (2006.01) |
| *C07K 16/00* | (2006.01) |
| *C07K 16/28* | (2006.01) |

(52) U.S. Cl.
CPC .......... *C07K 16/2851* (2013.01); *A61K 38/17* (2013.01); *A61K 38/212* (2013.01); *A61K 38/215* (2013.01); *A61K 39/395* (2013.01); *A61K 39/40* (2013.01); *A61K 39/42* (2013.01); *A61P 25/00* (2018.01); *C07K 14/4713* (2013.01); *C07K 16/00* (2013.01); *C07K 16/18* (2013.01); *C07K 2319/00* (2013.01)

(58) Field of Classification Search
CPC ............ A61K 2039/505; A61K 39/395; A61K 47/6849; C07K 2317/569; C07K 14/56; C07K 2319/33; C07K 2317/22; C07K 16/2851; C07K 2319/00; C07K 2317/622; C07K 2319/02; C07K 2317/31; C07K 16/2815; C07K 2319/30; C07K 2317/76; C07K 2317/565; C07K 2319/74; C07K 16/28; C07K 2317/56; C07K 2317/62; G01N 33/505
See application file for complete search history.

(56) References Cited

U.S. PATENT DOCUMENTS

| | | |
|---|---|---|
| 5,914,254 A | 6/1999 | Mascarenhas et al. |
| 8,580,266 B2 | 11/2013 | Sancho-Madrid et al. |
| 8,980,267 B2 | 3/2015 | Grewal et al. |
| 9,139,634 B2 | 9/2015 | Morrison et al. |
| 9,492,562 B2 | 11/2016 | Tavernier et al. |
| 9,534,056 B2 | 1/2017 | Grewal et al. |
| 9,732,135 B2 | 8/2017 | Tavernier et al. |
| 9,878,014 B2 | 1/2018 | Tavernier et al. |
| 9,914,759 B2 | 3/2018 | Tavernier et al. |
| 9,932,409 B2 | 4/2018 | Tavernier et al. |
| 10,034,919 B2 | 7/2018 | Tavernier et al. |
| 10,035,835 B2 | 7/2018 | Tavernier et al. |
| 10,072,059 B2 | 9/2018 | Tavernier et al. |
| 10,407,480 B2 | 9/2019 | Tavernier et al. |
| 10,640,542 B2 | 5/2020 | Tavernier et al. |
| 11,001,631 B2 * | 5/2021 | Tavernier ............. A61K 39/395 |
| 11,084,859 B2 * | 8/2021 | Kley ...................... A61P 37/02 |
| 2010/0172868 A1 | 7/2010 | Morrison et al. |
| 2010/0297076 A1 | 11/2010 | Morrison et al. |
| 2011/0020273 A1 | 1/2011 | Chang et al. |
| 2011/0081341 A1 | 4/2011 | Honjo et al. |

(Continued)

FOREIGN PATENT DOCUMENTS

| | | |
|---|---|---|
| RU | 2011127226 A | 1/2013 |
| WO | WO 91/02754 A1 | 3/1991 |

(Continued)

OTHER PUBLICATIONS

U.S. Appl. No. 17/598,573 filed Sep. 2021, Kley; Nikolai.*
MacCallum et al., J. Mol. Biol., 1996; 262: 732-745.*
Pascalis et al., The Journal of Immunology, 2002; 169: 3076-3084.*
Casset et al., BBRC, 2003; 307: 198-205.*
Vajdos et al., J. Mol. Biol. 2002; 320: 415-428.*
Holm et al., Mol. Immunol., 2007; 44: 1075-1084.*
Chen et al.,J. Mol. Bio., 1999; 293: 865-881.*
Wu et al.,J. Mol. Biol., 1999; 294:151-162.*

(Continued)

*Primary Examiner* — Chang-Yu Wang
(74) *Attorney, Agent, or Firm* — Morgan, Lewis & Bockius LLP

(57) ABSTRACT

The present invention relates, in part, to agents that bind Clec9A and their use as diagnostic and therapeutic agents. The present invention further relates to pharmaceutical compositions comprising the Clec9A binding agents and their use in the treatment of various diseases.

8 Claims, 18 Drawing Sheets

Specification includes a Sequence Listing.

(56) References Cited

U.S. PATENT DOCUMENTS

| | | |
|---|---|---|
| 2011/0104112 A1 | 5/2011 | Morrison et al. |
| 2011/0224407 A1 | 9/2011 | Langer et al. |
| 2011/0274658 A1 | 11/2011 | Silver et al. |
| 2013/0183298 A1 | 7/2013 | Le et al. |
| 2013/0230517 A1 | 9/2013 | Grewal et al. |
| 2014/0271462 A1 | 9/2014 | Ho et al. |
| 2014/0328865 A1 | 11/2014 | Sancho-Madrid et al. |
| 2014/0348789 A1 | 11/2014 | Tavernier et al. |
| 2015/0139951 A1 | 5/2015 | Grewal et al. |
| 2015/0265721 A1 | 9/2015 | Lahoud et al. |
| 2015/0313965 A1 | 11/2015 | Pogue et al. |
| 2016/0075769 A1 | 3/2016 | Verheesen et al. |
| 2016/0145325 A1 | 5/2016 | Verheesen et al. |
| 2018/0186894 A1 | 7/2018 | Tavernier et al. |
| 2018/0333465 A1 | 11/2018 | Tavernier et al. |
| 2018/0334488 A1 | 11/2018 | Tavernier et al. |
| 2018/0334489 A1 | 11/2018 | Tavernier et al. |
| 2019/0010199 A1 | 1/2019 | Tavernier et al. |
| 2019/0071500 A1 | 3/2019 | Kley et al. |
| 2019/0144553 A1 | 5/2019 | Kley et al. |
| 2019/0194284 A1 | 6/2019 | Kley et al. |
| 2019/0202934 A1 | 7/2019 | Tavernier et al. |
| 2019/0351021 A1 | 11/2019 | Tavernier et al. |
| 2019/0352406 A1 | 11/2019 | Tavernier et al. |
| 2019/0367575 A1 | 12/2019 | Tavernier et al. |
| 2019/0367604 A1 | 12/2019 | Kley et al. |
| 2020/0055912 A1* | 2/2020 | Kley .................. A61P 31/04 |
| 2020/0071414 A1 | 3/2020 | Kley et al. |
| 2020/0087411 A1 | 3/2020 | Kley et al. |
| 2021/0024631 A1* | 1/2021 | Kley .................. C07K 16/2896 |

FOREIGN PATENT DOCUMENTS

| | | |
|---|---|---|
| WO | WO 03/033720 A2 | 4/2003 |
| WO | WO 2006/053883 A1 | 4/2003 |
| WO | WO 2006/115800 A2 | 11/2006 |
| WO | WO 2008/014612 A1 | 2/2008 |
| WO | WO 2008/124086 A2 | 10/2008 |
| WO | WO 2009/003145 A1 | 12/2008 |
| WO | WO 2009/013484 A1 | 1/2009 |
| WO | WO 2009/039409 A1 | 3/2009 |
| WO | WO 2010/036918 A2 | 4/2010 |
| WO | WO 2010/066740 A1 | 6/2010 |
| WO | WO 2011/020783 A2 | 2/2011 |
| WO | WO 2011/029870 A1 | 3/2011 |
| WO | WO 2012/170072 A1 | 12/2012 |
| WO | WO 2013/053008 A2 | 4/2013 |
| WO | WO 2013/059885 A2 | 5/2013 |
| WO | WO 2013/107791 A1 | 7/2013 |
| WO | WO 2013/134138 A1 | 9/2013 |
| WO | WO 2013/163689 A1 | 11/2013 |
| WO | WO 2015/007520 A1 | 1/2015 |
| WO | WO 2015/007536 A2 | 1/2015 |
| WO | WO 2015/007542 A1 | 1/2015 |
| WO | WO 2015/007903 A1 | 1/2015 |
| WO | WO 2015/018528 A1 | 2/2015 |
| WO | WO 2016/187459 A1 | 11/2016 |
| WO | WO 2017/077382 A1 | 5/2017 |
| WO | WO 2017/134302 A2 | 8/2017 |
| WO | WO 2017/194782 A2 | 11/2017 |
| WO | WO 2018/077893 A1 | 5/2018 |
| WO | WO 2018/144999 A1 | 8/2018 |

OTHER PUBLICATIONS

Burgess et al. J of Cell Bio. 1990, 111:2129-2138.*
Bowie et al. Science, 1990, 247:1306-1310.*
Pawson et al. 2003, Science 300:445-452.*
Alaoui-Ismaili et al., Cytokine Growth Factor Rev. 2009; 20:501-507.*
Guo et al., PNAS 2004; 101:9205-9210.*
Rudikoff et al., Proc. Natl. Acad. Sci. USA 1982 Vol. 79: p. 1979.*
Park et al. NPJ Vaccines, 2017; 2:31; doi:10.1038/s41541-017-0033-5.*

Acres, et al., "Fusokine Interleukin-2/Interleukin-18, a Novel Potent Innate and Adaptive Immune Stimulator with Decreased Toxicity," Cancer Res., vol. 65, No. 20, pp. 9536-9546, 2005.
Baba, et al., "Identification of CCR6, the Specific Receptor for a Novel Lymphocyte-Directed CC Chemokine LARC," The Journal of Biological Chemistry, vol. 272, No. 23, p. 14893-14898, 1997.
Barbara, et al., "Dissociation of TNF-α cytotoxic and proinflammatory activities by p55 receptor-and p75 receptor-selective TNF-α mutants," EMBO Journal, vol. 13, No. 4, pp. 843-850, 1994.
Bork, et al., "Go hunting in sequence databases but watch out for the traps." Trends in Genetics, vol. 12, pp. 125-427, 1996.
Bork, "Powers and Pitfalls in Sequence Analysis: The 70% Hurdle," Genome Research, vol. 10, pp. 398-400, 2000.
Boschert, et al., "Single chain TNF derivatives with individually mutated receptor binding sites reveal differential stoichiometry of ligand receptor complex formation for TNFR1 and TNER2," Cellular Signalling 22 (7):1088-1096, 2010.
Bremer, et al., "Superior activity of fusion protein scFvRit:sFasL over cotreatment with rituximab and Fas agonists," Cancer Res. 68: 597-604, 2008.
Camacho, et al., "Structure of an Interleukin-1β Mutant With Reduced Bioactivity Shows Multiple Subtle Changes in Conformation That Affect Protein-Protein Recognition," Biochemistry, vol. 32, No. 34, pp. 8749-8757, 1993.
Coulstock, et al., "Liver-Targeting of Interferon-Alpha with Tissue Specific Domain Antibodies," PLoS One, vol. 8, No. 2, pp. 1-11, 2013.
De Bruyn, et al., "Antibody-Based Fusion Proteins to Target Death Receptors in Cancer," Cancer Letters, vol. 332, pp. 175-183, 2013.
Deffar, et al., "Nanobodies—The New Concept in Antibody Engineering," African Journal of Biotechnology, vol. 8, No. 12, pp. 2645-2652, 2009.
Dijkmans, et al., "Murine Interferon-γ Interleukin-1 Fusion Proteins Used as Antigens for the Generation of Hybridomas Producing Monoclonal Anti-Interleukin-1 Antibodies," Cytokine, vol. 3, No. 2, pp. 134-140, 1991.
Dimitrov, "Engineered CH2 Domains (Nanoantibodies)," mAbs, Landes Bioscience, vol. 1, No. 1, pp. 26-28, 2009.
Frey, et al., "Antibody-Based Targeting of Interferon-Alpha to the Tumor Neovasculature: A Critical Evaluation," ntegrative Biology, vol. 3, pp. 468-478, 2011.
Garcin, et al., "High Efficiency cell-specific targeting of cytokine activity," Nature Communications, vol. 5, No. 8, 9 pages, 2014.
Garlanda, et al., "The Interleukin-1 Family: Back to the Future," Immunity, 39 (6): pp. 1003-1018, Dec. 12, 2013.
Holler, et al., "Two Adjacent Trimeric Fas Ligands are Required for Fas Signaling and Formation of a Death-Inducing Signaling Complex," Molecular and Cellular Biology, vol. 23, No. 4, pp. 1428-1440, 2003.
Huang, et al., "A Trimeric Anti-HER2/neu ScFv and Tumor Necrosis Factor-[alpha] Fusion Protein Induces HER2/ Neu Signaling and Facilitates Repair of Injured Epithelia," The Journal of Pharmacology and Experimental Therapeutics, vol. 316, No. 3, pp. 983-991, 2006.
International Search Report & Written Opinion, PCT Application No. PCT/EP2017/052544, dated Jun. 6, 2017, 16 pages.
Idoyaga, et al., "Comparable T helper 1 (Th1) and CD8 T-cell immunity by targeting HIV gag p24 to CD8 dendritic cells within antibodies to Langerin, DEC205, and Clec9A," PNAS, vol. 108, No. 6, pp. 2384-2389, Jan. 24, 2011.
Kircheis, et al., "Biological activity of mutants of human tumour necrosis factor-alpha," Immunology, pp. 433-438, Jul. 1, 1992.
Krippner-Heidenreich, et al., "Single-Chain TNF, a TNF Derivative with Enhanced Stability and Antitumoral Activity," The Journal of Immunology, vol. 180, pp. 8176-8183, 2008.
Lahoud, et al., "Targeting Antigen to Mouse Dendritic Cells via Clec9A Induces Potent CD4 T Cell Responses Biased toward a Follicular Helper Phenotype," The Journal of Immunology, vol. 187, No. 2, pp. 842-850, Jul. 15, 2011.
Loetscher, et al., "Human Tumor Necrosis Factor a (TNFα) Mutants with Exclusive Specificity for 55-kDA or 75-kDa TNF Receptors,"

(56) References Cited

OTHER PUBLICATIONS

Journal of Biological Chemistry, American Society For Biochemistry and Molecular Biology, US, vol. 268, No. 35, pp. 26350-26357, 1993.
Masci, et al., "New and Modified Interferon alfas: Preclinical and Clinical Data," Current Oncology Reports, vol. 5, pp. 108-113, 2003.
Minn, "Interferons and the Immunogenic Effects of Cancer Therapy," Trends In Immunology, vol. 36, No. 11, pp. 725-737, Nov. 1, 2015.
Ngo, et al., "Computational Complexity, Protein Structure Prediction, and the Levinthal Paradox. The Protein Folding Problem and Tertiary Structure Prediction," Edited by: Mertz et al., (Birkhauser, Boston), pp. 491-495, 1994.
Pan, et al., "Mutation of the IFNAR-1 Receptor Binding Site of Human IFN-α2 Generates Type I IFN Competitive Antagonists," Biochemistry, vol. 47, pp. 12018-12027, 2008.
Patris, et al., "Nanoimmunoassay onto a screen printed electrode for HER2 breast cancer biomarker determination," Talanta, 2014, vol. 130, pp. 164-170, 2014.
Penafuerte, et al., "The Human Ortholog of Granulocyte Macrophage Colony-Stimulating Factor and Interleukin-2 fusion Protein Induces Potent Ex Vivo Natural Killer Cell Activation and Maturation," Cancer Res, vol. 69, No. 23, pp. 9020-9028, 2009.
Picco, et al., "Targeting DNGR-1 (CLEC9A) with antibody/MUC1 peptide conjugates as a vaccine for carcinomas," European Journal of Immunology, vol. 44, No. 7, pp. 1947-1955, Apr. 17, 2014.
Puskas, et al., "Development of an attenuated interleukin-2 fusion protein that can be activated by tumour-expressed proteases," Immunology, vol. 133, No. 2, pp. 206-220, Jun. 23, 2011.
Rafei, et al., "A MCP1 Fusokine with CCR2-Specific Tumoricidal Activity," Molecular Cancer, vol. 10, No. 121, pp. 1-11, 2011.
Rafei, et al., "An Engineered GM-CSF-CCL2 Fusokine Is a Potent Inhibitor of CCR2-Driven Inflammation as Demonstrated in a Murine Model of Inflammatory Arthritis," The Journal of Immunology, vol. 183, pp. 1759-1766, 2009.
Roisman, et al., "Structure of the Interferon-Receptor Complex Determined by Distant Constraints from Double Mutant Cycles and Flexible Docking," PNAS, vol. 98, No. 23, pp. 13231-13236, 2001.
Rovero, et al., "Insertion of the DNA for the 163-171 Peptide of IL 1 II Enables a DNA Vaccine Encoding p185$^{neu}$ to inhibit Mammary Carcinogenesis in Her-2/neu Transgenic BALB/c Mice," Gene Therapy, vol. 8, pp. 447-452, 2001.
Sancho, et al., "Identification of a dendritic cell receptor that couples sensing of necrosis to immunity," Nature, Nature Publishing Group, United Kingdom, vol. 453, No. 7240, pp. 899-903, Apr. 16, 2009.
Schutyser, et al., "The CC Chemokine CCL20 and its Receptor CCR6," Cytokine & Growth Factor Reviews, vol. 14, pp. 409-426, 2003.
Vaneycken, et al., "Preclinical Screening of Anti-HER2 Nanobodies for Molecular Imaging of Breast Cancer", The ASEB Journal, vol. 25, pp. 2433-2446, 2011.
Weber, et al., "Single Amino Acid Changes that Render Human IFN-α2 Biologically Active on Mouse Cells," The EMBO Journal, vol. 6, No. 3, pp. 591-598, 1987.
Wells, "Additivity of Mutational Effects in Proteins," Biochemistry, vol. 29, No. 37, pp. 8509-8517, 1990.
Wesolowski, et al., "Single Domain Antibodies: Promising Experimental and Therapeutic Tools in Infection and Immunity," Med. Microbiol. Immunol., vol. 198, pp. 157-174, 2009.
Zitvogel, et al., "Type I interferons in anticancer immunity," The Journal of Immunology, vol. 15, No. 7, pp. 405-141, Jun. 1, 2015.
International Search Report & Written Opinion PCT Appl. No. PCT/US18/45742, dated Dec. 6, 2018, 20 pages.

\* cited by examiner

| | | | |
|---|---|---|---|
| SEQ ID NO: 1104 | 31EC55.1 | CTAG | 408 |
| SEQ ID NO: 1105 | 21EC26.1 | CTAG | 408 |
| SEQ ID NO: 1106 | 11EC94.1 | CTAG | 408 |
| SEQ ID NO: 1107 | 11EC46.1 | CTAG | 408 |
| SEQ ID NO: 1108 | 31EC43.1 | CTAG | 408 |
| SEQ ID NO: 1109 | 11EC30.1 | CTAG | 408 |
| SEQ ID NO: 1110 | 21EC55.1 | CTAG | 411 |
| SEQ ID NO: 1111 | 11EC38.1 | CTAG | 408 |
| SEQ ID NO: 1112 | 11EC64.1 | CTAG | 405 |
| SEQ ID NO: 1113 | 21EC93.1 | CTAG | 405 |
| SEQ ID NO: 1114 | 21EC53.1 | CTAG | 405 |
| SEQ ID NO: 1115 | 21EC63.1 | CTAG | 405 |
| SEQ ID NO: 1116 | 11EC63.1 | CTAG | 405 |
| SEQ ID NO: 1117 | 11EC30.1 | CTAG | 408 |
| SEQ ID NO: 1118 | 11EC42.1 | CTAG | 405 |
| SEQ ID NO: 1119 | 11EC9.1 | CTAG | 405 |
| SEQ ID NO: 1120 | 11EC76.1 | CTAG | 405 |
| SEQ ID NO: 1121 | 21EC62.1 | CTAG | 426 |
| SEQ ID NO: 1122 | 31EC23.1 | CTAG | 408 |
| SEQ ID NO: 1123 | 21EC48.1 | CTAG | 408 |
| SEQ ID NO: 1124 | 21EC54.1 | CTAG | 405 |
| SEQ ID NO: 1125 | 21EC93.1 | CTAG | 414 |
| SEQ ID NO: 1126 | 11EC6.1 | CTAG | 411 |
| SEQ ID NO: 1127 | 31EC22.1 | CTAG | 411 |
| SEQ ID NO: 1128 | 21EC24.1 | CTAG | 438 |
| SEQ ID NO: 1129 | 21EC94.1 | CTAG | 438 |
| SEQ ID NO: 1130 | 21EC95.1 | CTAG | 438 |
| SEQ ID NO: 1131 | 21EC67.1 | CTAG | 417 |
| SEQ ID NO: 1132 | 11EC62.1 | CTAG | 405 |
| SEQ ID NO: 1133 | 31EC15.1 | CTAG | 405 |
| SEQ ID NO: 1134 | 31EC9.1 | CTAG | 420 |
| SEQ ID NO: 1135 | 31EC61.1 | CTAG | 420 |
| SEQ ID NO: 1136 | 31EC82.1 | CTAG | 420 |
| SEQ ID NO: 1137 | 11EC51.1 | CTAG | 408 |
| SEQ ID NO: 1138 | 31EC27.1 | CTAG | 408 |
| SEQ ID NO: 1139 | 31EC6.1 | CTAG | 408 |
| SEQ ID NO: 1140 | 11EC91.1 | CTAG | 432 |

| | | | |
|---|---|---|---|
| SEQ ID NO: 1202 | 3LEC21 | ........YW---GQGTQVTVSSAAAYPYDVPDYGSHHHHHH | : 136 |
| SEQ ID NO: 1203 | 3LEC6 | ........YW---GQGTQVTVSSAAAYPYDVPDYGSHHHHHH | : 136 |
| SEQ ID NO: 1204 | 3LEC9 | .....V---DYW---GQGTQVTVSSAAAYPYDVPDYGSHHHHHH | : 140 |
| SEQ ID NO: 1205 | 3LEC61 | .....V---DYW---GQGTQVTVSSAAAYPYDVPDYGSHHHHHH | : 140 |
| SEQ ID NO: 1206 | 3LEC83 | .....A---DYW---GQGTQVTVSSAAAYPYDVPDYGSHHHHHH | : 140 |

Figure 3

| Group | Member(s) |
|---|---|
| 1 | 1LEC42, 3LEC89, 2LEC38, 1LEC7, 3LEC57, 2LEC68, 1LEC61, 3LEC36, 2LEC61, 1LEC64, 2LEC93, 1LEC30, 1LEC63, 2LEC53, 2LEC63 |
| 2 | 3LEC62, 2LEC90, 3LEC55, 2LEC26, 1LEC94, 3LEC30, 1LEC26, 3LEC23, 1LEC27, 2LEC55, 1LEC38 |
| 3 | 1LEC92, 3LEC11 |
| 4 | 1LEC70 |
| 5 | 3LEC4 |
| 6 | 2LEC13, 2LEC89, 2LEC83 |
| 7 | 3LEC76 |
| 8 | 2LEC16, 3LEC66, 2LEC59, 1LEC28, 2LEC20, 2LEC88 |
| 9 | 2LEC60, 3LEC13 |
| 10 | 3LEC69 |
| 11 | 1LEC88 |
| 12 | 1LEC84 |
| 13 | 3LEC15 |
| 14 | 1LEC9, 2LEC76 |
| 15 | 2LEC62 |
| 16 | 2LEC6 |
| 17 | 2LEC24, 3LEC94, 2LEC95 |
| 18 | 2LEC23, 2LEC48 |
| 19 | 2LEC67 |
| 20 | 3LEC22 |
| 21 | 1LEC91 |
| 22 | 2LEC54 |
| 23 | 1LEC62 |
| 24 | 1LEC51, 3LEC27, 3LEC6 |
| 25 | 3LEC9, 3LEC61, 3LEC82 |

Clec9A BINDING AGENTS COMPRISING A RECOMBINANT HEAVY-CHAIN ONLY ANTIBODY (VHH)

CROSS-REFERENCE TO RELATED APPLICATIONS

The present application is a 371 national stage entry of International Application No. PCT/US18/45742, filed Aug. 8, 2018, which claims the benefit of and priority to U.S. Provisional Patent Application No. 62/542,944, filed Aug. 9, 2017, the content of which is hereby incorporated by reference in its entirety.

FIELD

The present invention relates, in part, to binding agents which bind Clec9A and their use as therapeutic and diagnostic agents.

DESCRIPTION OF THE TEXT FILE SUBMITTED ELECTRONICALLY

The contents of the text file submitted electronically herewith are incorporated herein by reference in their entirety: A computer readable format copy of the Sequence Listing (filename: ORN-033PC_ST25, date created: Aug. 8, 2018; file size: 808 KB).

BACKGROUND

Dendritic cells (DCs) are antigen-presenting cells (APCs) that process antigens and display them to other cells of the immune system. Specifically, dendritic cells are capable of capturing and presenting antigens on their surfaces to activate T cells such as cytotoxic T cells (CTLs). Further, activated dendritic cells are capable of recruiting additional immune cells such as macrophages, eosinophils, natural killer cells, and T cells such as natural killer T cells.

Given the important role of dendritic cells in immunity, derailed dendritic cell functions have been implicated in diseases such as cancer and autoimmune diseases such as multiple sclerosis. For example, cancer cells may evade immune detection and destruction by crippling dendritic cell functionality through prevention of dendritic cell recruitment and activation. In addition, dendritic cells have been found in the brain during central nervous system inflammation and may be involved in the pathogenesis of autoimmune diseases in the brain.

Accordingly, there remains a need for improved therapies for diseases including cancer and multiple sclerosis by modifying dendritic cell functions.

SUMMARY

In various aspects, the present invention relates to Clec9A binding agents having at least one targeting moiety that specifically binds to Clec9A. In various embodiments, these Clec9A binding agents bind to, but do not functionally modulate (e.g. partially or fully neutralize) Clec9A. Therefore, in various embodiments, the present Clec9A binding agents have use in, for instance, directly or indirectly recruiting a Clec9A-expressing cell to a site of interest while still allowing the Clec9A-expressing cell to signal via Clec9A (i.e. the binding of the Clec9A binding agent does not reduce or eliminate Clec9A signaling at the site of interest). In an embodiment, the targeting moiety is a single domain antibody (VHH). In various embodiments, the Clec9A binding agent further comprises a signaling agent, e.g., without limitation, an interferon, an interleukin, and a tumor necrosis factor, that may be modified to attenuate activity. In various embodiments, the Clec9A binding agent comprises additional targeting moieties that bind to other targets (e.g. antigens, receptor) of interest. In an embodiment, the other targets (e.g. antigens, receptor) of interest are present on tumor cells. In another embodiment, the other targets (e.g. antigens, receptor) of interest are present on immune cells. In some embodiments, the present Clec9A binding agent may directly or indirectly recruit an immune cell (e.g. a dendritic cell) to a site of action (such as, by way of non-limiting example, the tumor microenvironment). In some embodiments, the present Clec9A binding agent facilitates the presentation of antigens (e.g., tumor antigens) by dendritic cells.

In various embodiments, the present Clec9A binding agents find use in the treatment of various diseases or disorders such as cancer, infections, immune disorders, and other diseases and disorders, and the present invention encompasses various methods of treatment.

BRIEF DESCRIPTION OF DRAWINGS

Figure 1:
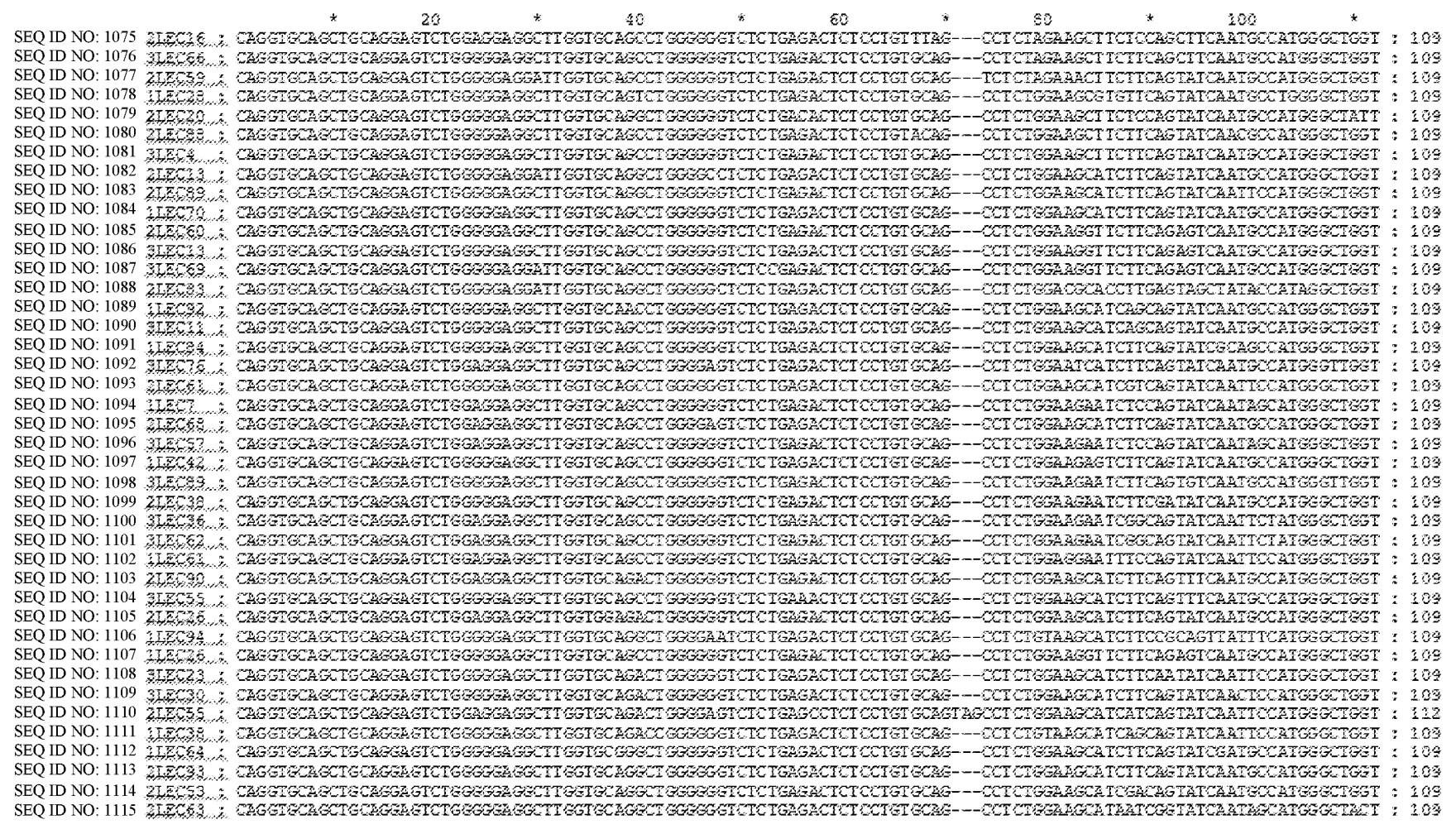
Figure 1:
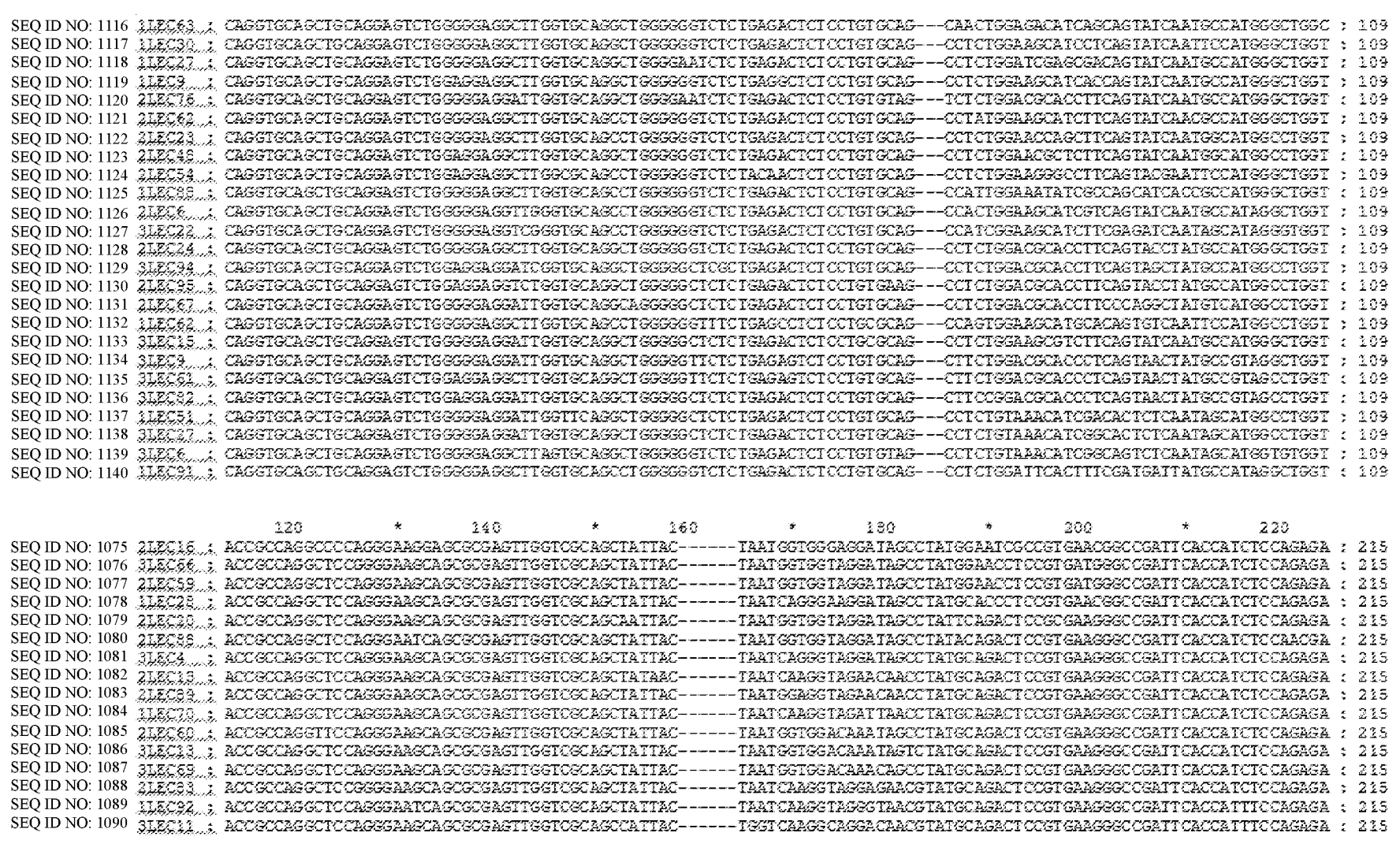
Figure 1:
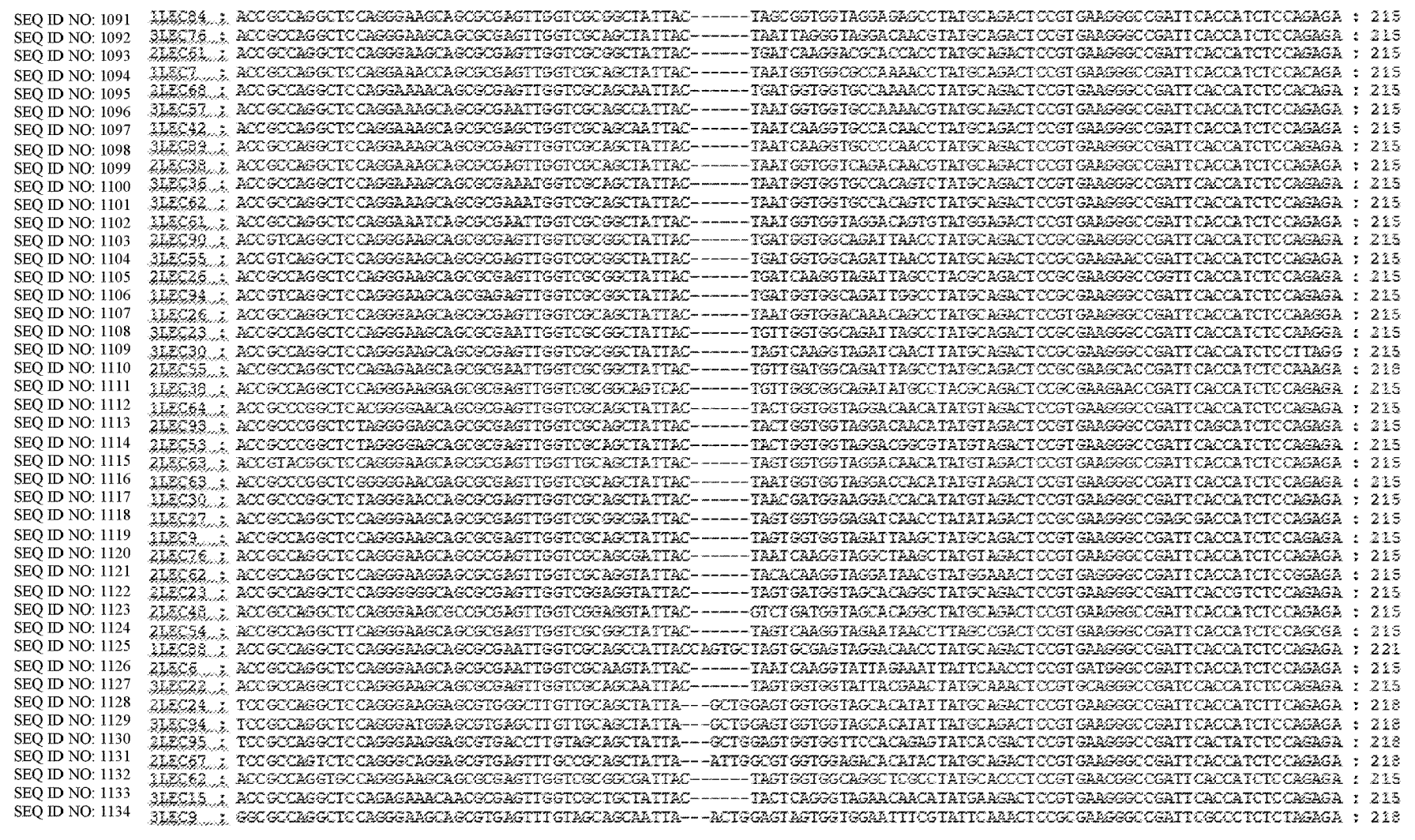
Figure 1:
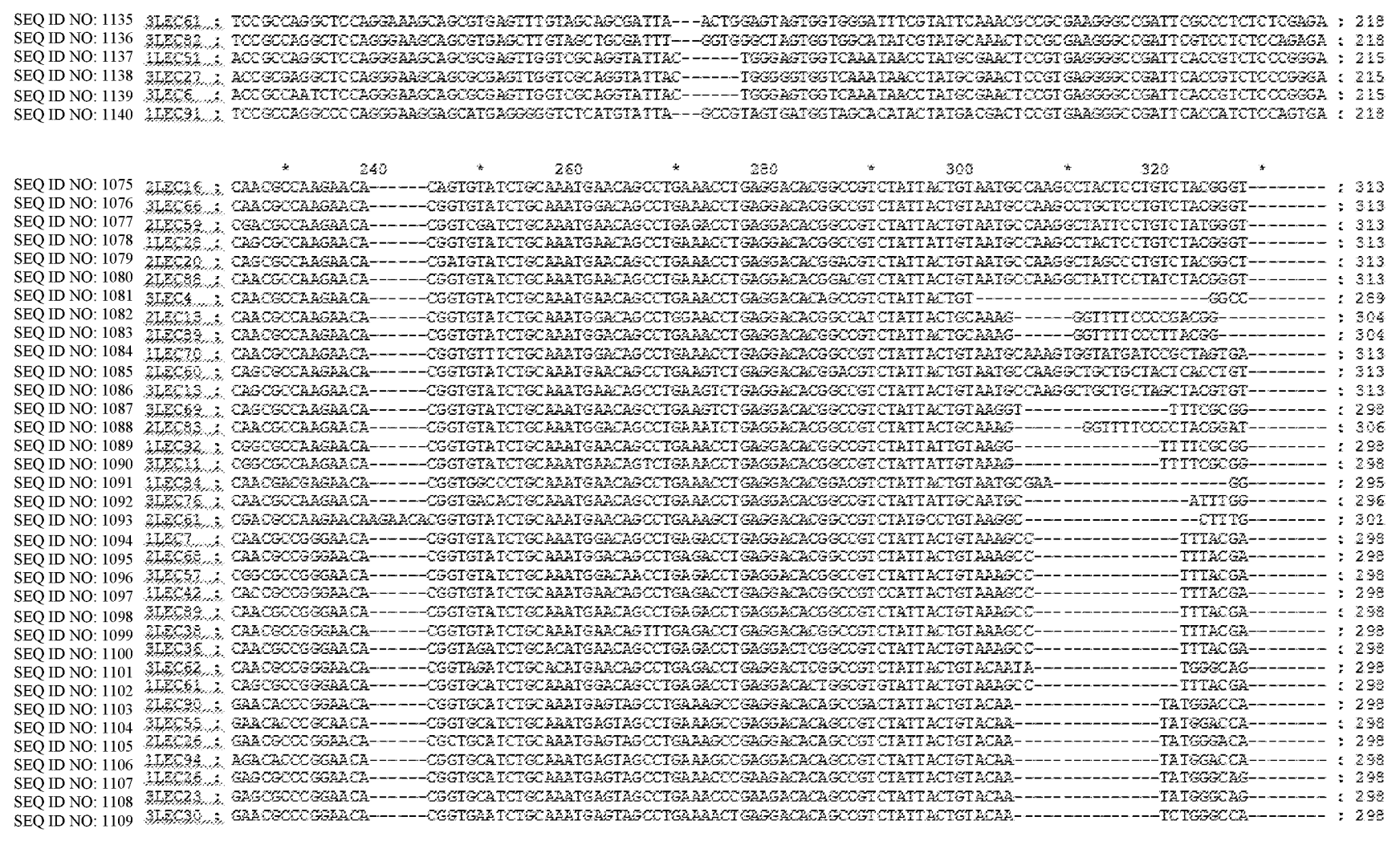
Figure 1:
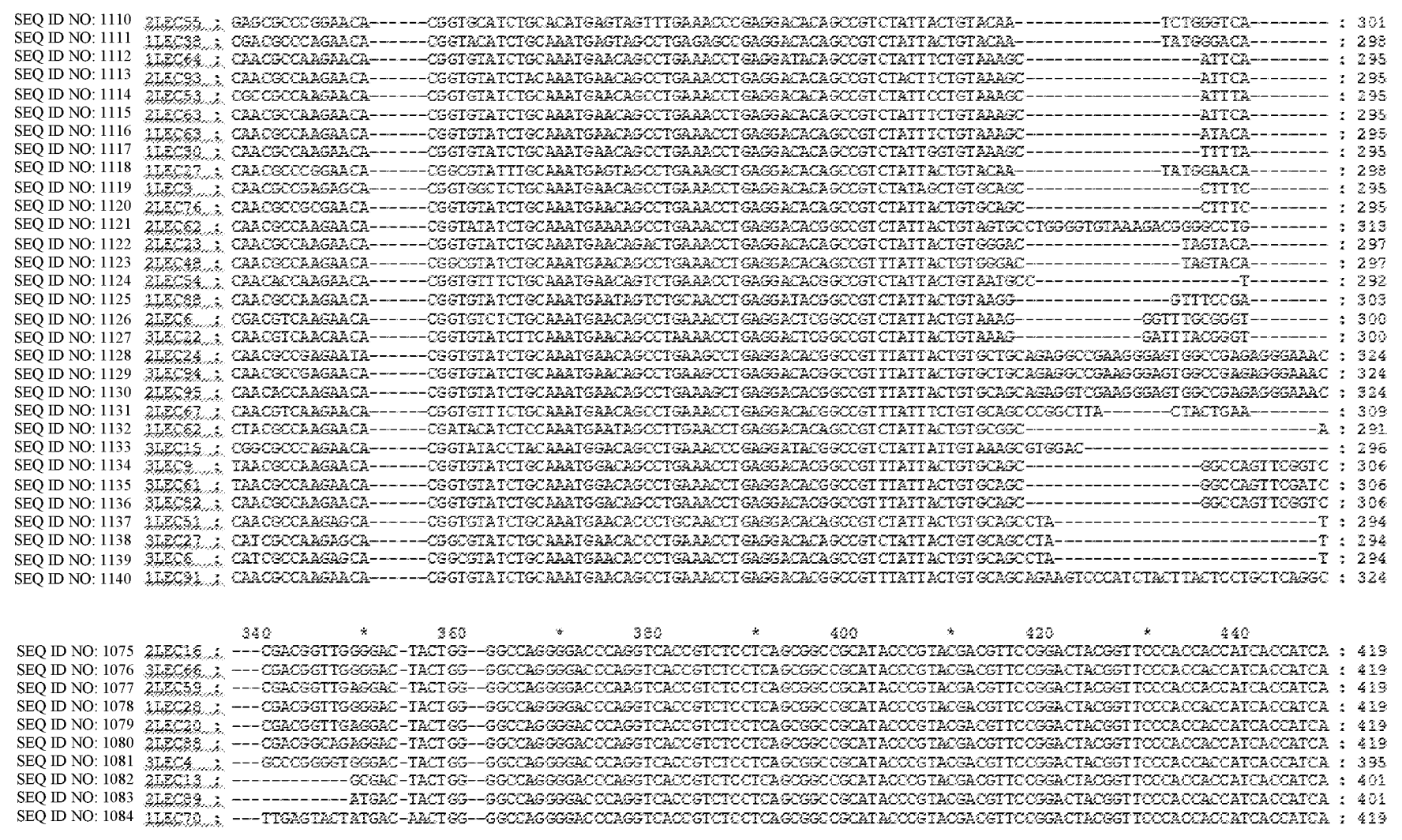
Figure 1:
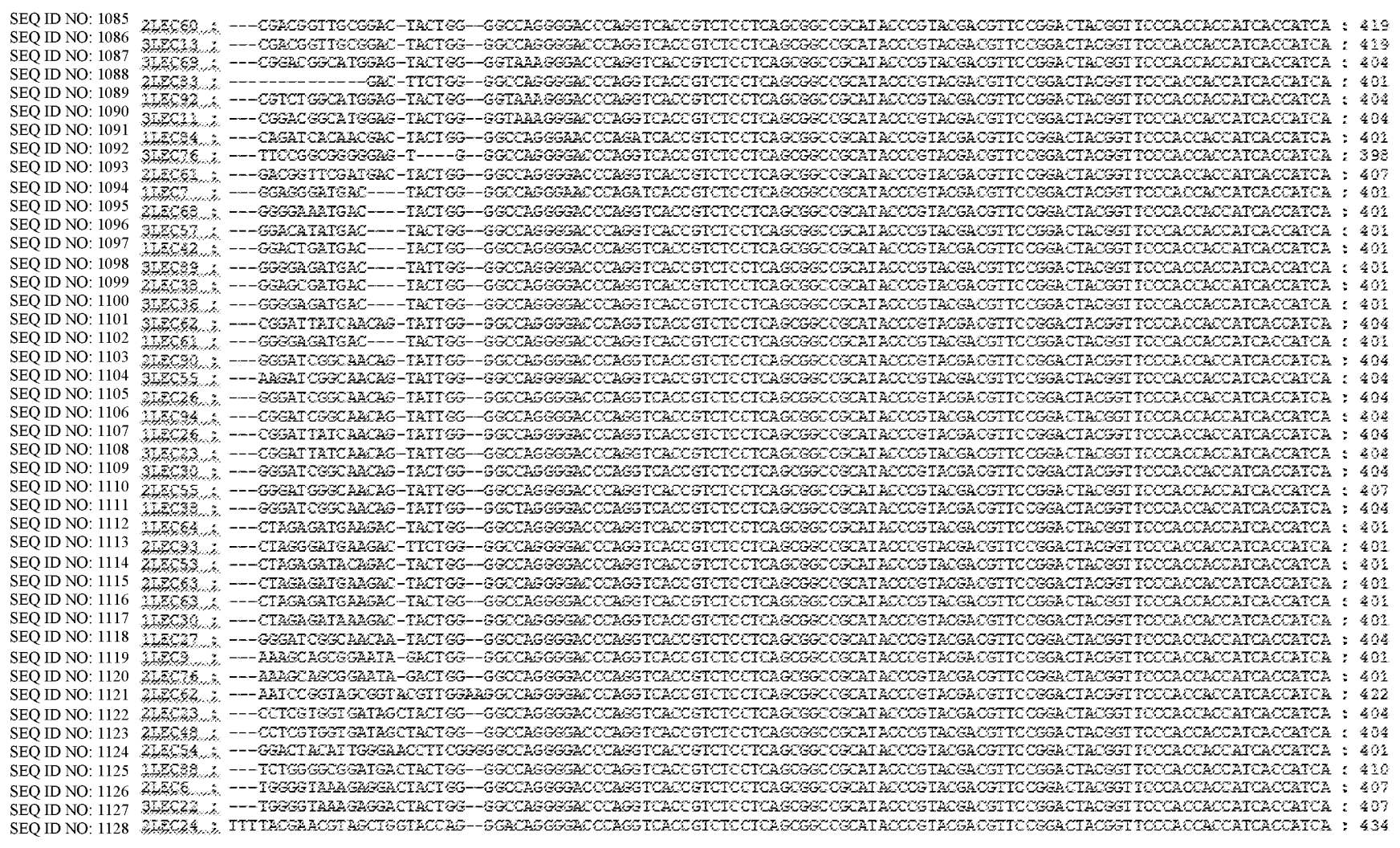
Figure 1:
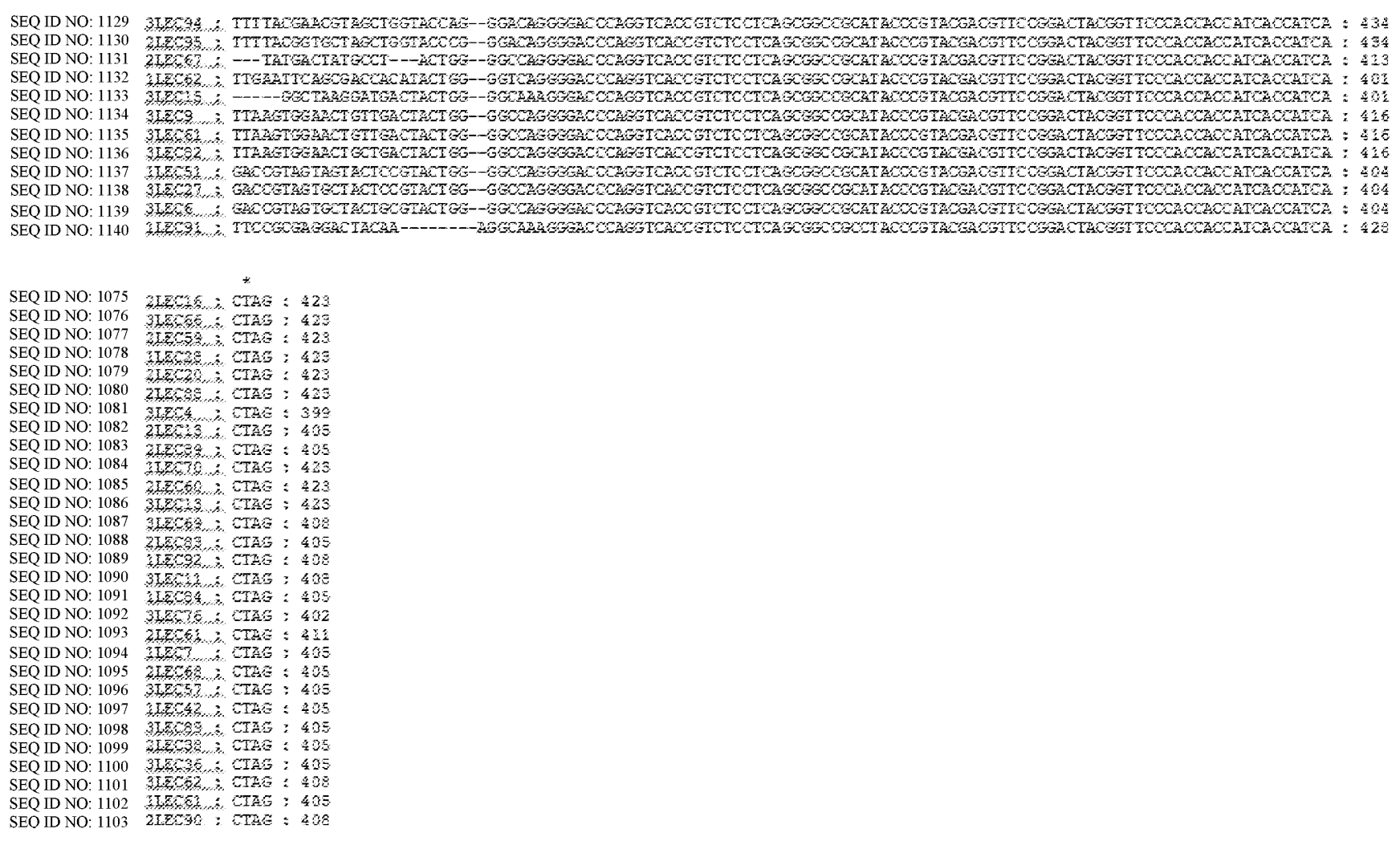

FIG. 1 depicts the nucleotide sequence of 66 different VHHs specific for human Clec9A. Gaps were introduced in order to align sequences. The sequences of FIG. 1 are assigned sequence identifiers as shown in Example 1.

Figure 2:
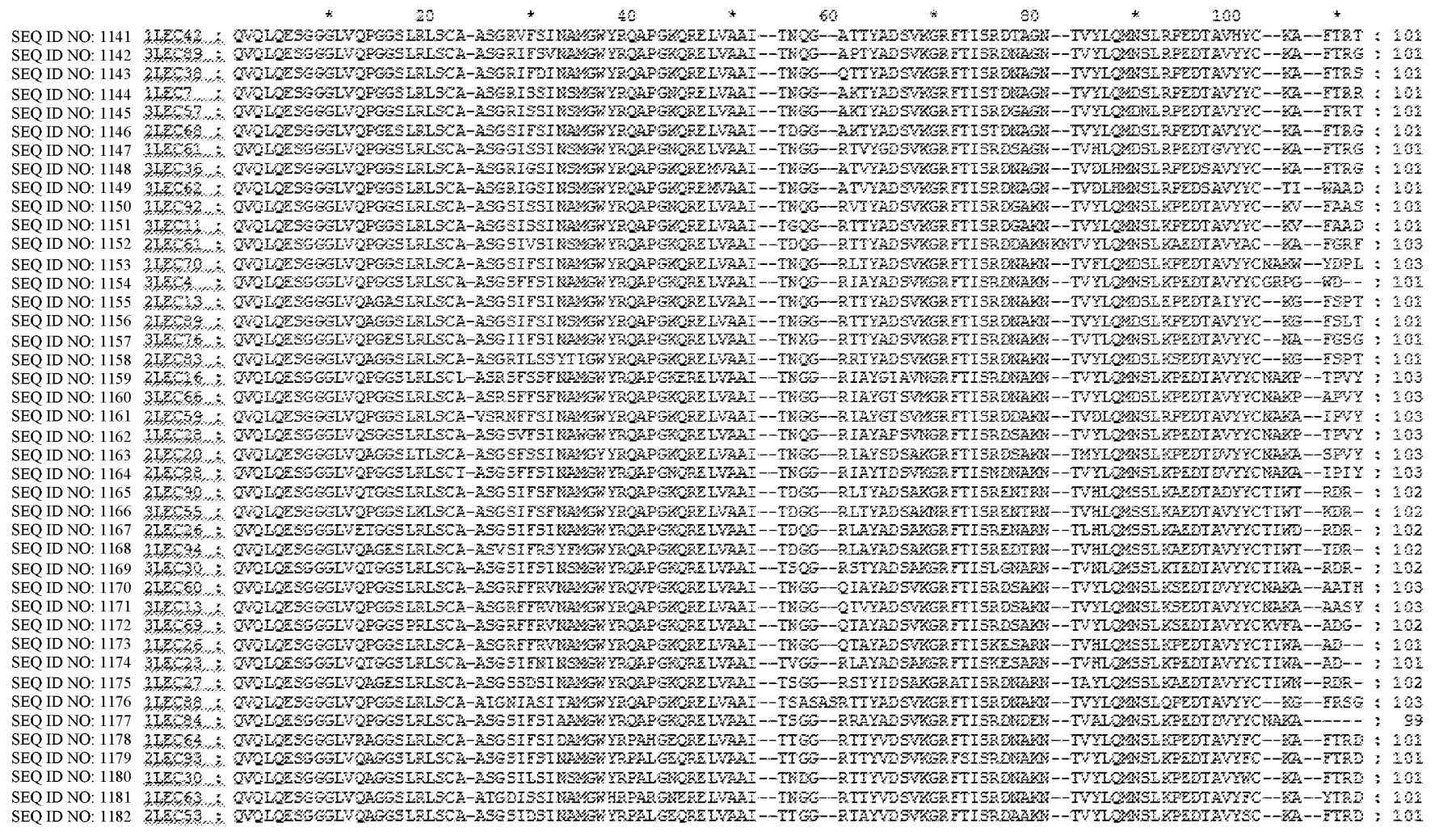
Figure 2:
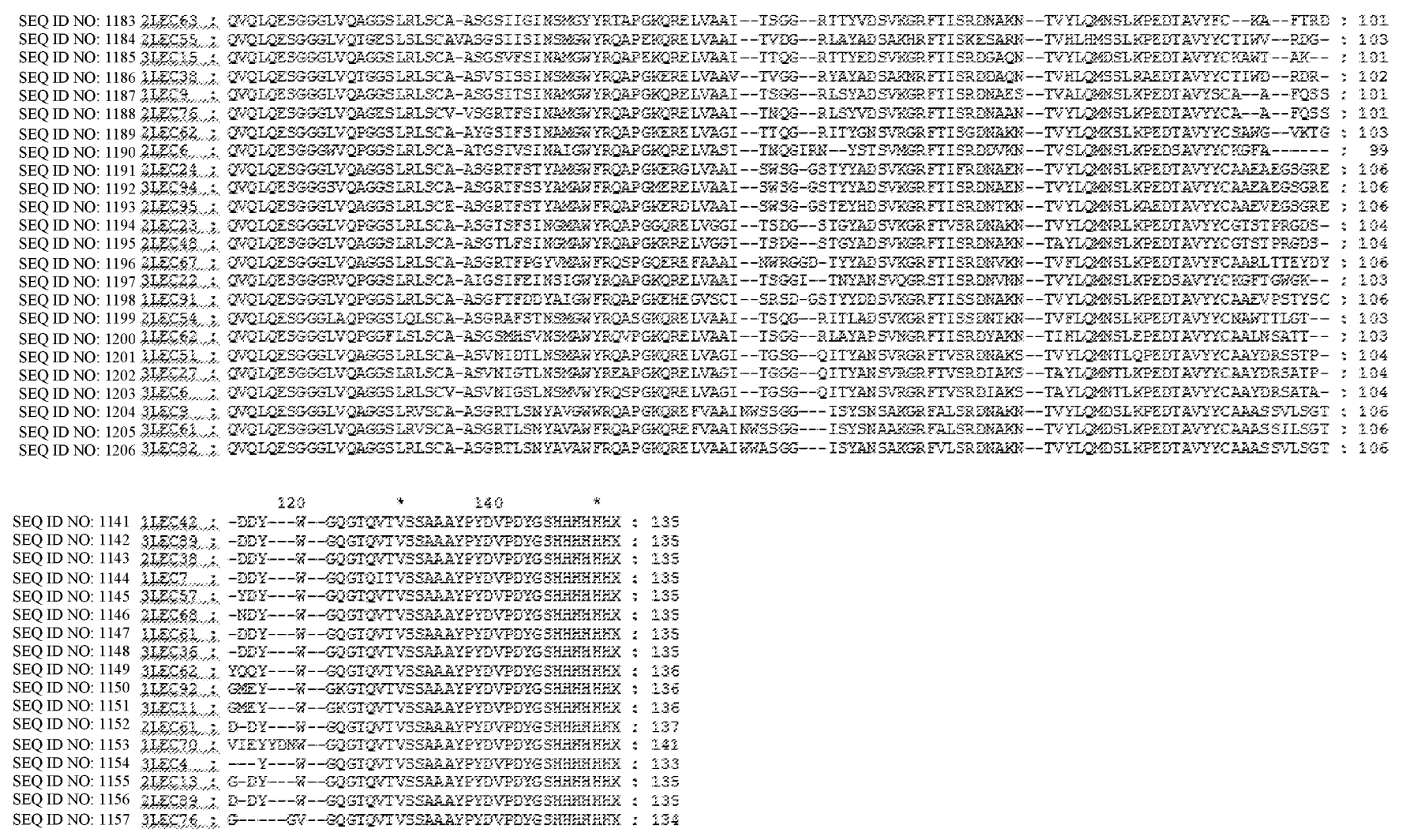
Figure 2:
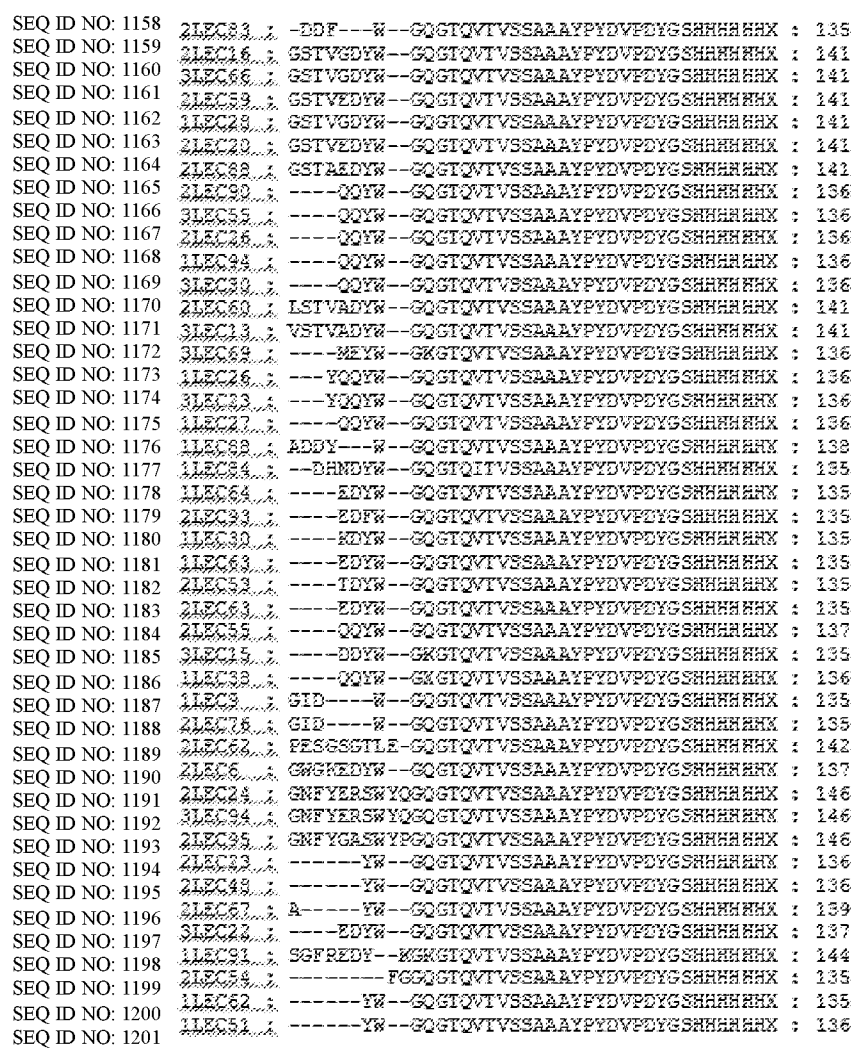

FIG. 2 shows the amino acid sequences of 66 different VHHs specific for human Clec9A. Complementarity determining regions (CDR1, CDR2 and CDR3) as indicated are defined according to Kabat. Gaps were introduced in order to align sequences. The above 66 different VHHs belong to 25 different CDR3 groups (see FIG. 3). VHHs belonging to the same group are very similar and their amino acid sequences suggest that they are from clonally-related B-cells resulting from somatic hypermutation or from the same B-cell but diversified due to RT and/or PCR error during library construction. VHHs belonging to the same group recognize the same epitope but their other characteristics (e.g. affinity, potency, stability, expression yield, etc.) can be different. The sequences of FIG. 2 are assigned sequence identifiers as shown in Example 1.

FIG. 3 provides a table depicting that the 66 different VHHs belonged to 25 different CDR3 groups.

DETAILED DESCRIPTION

Figure 4:
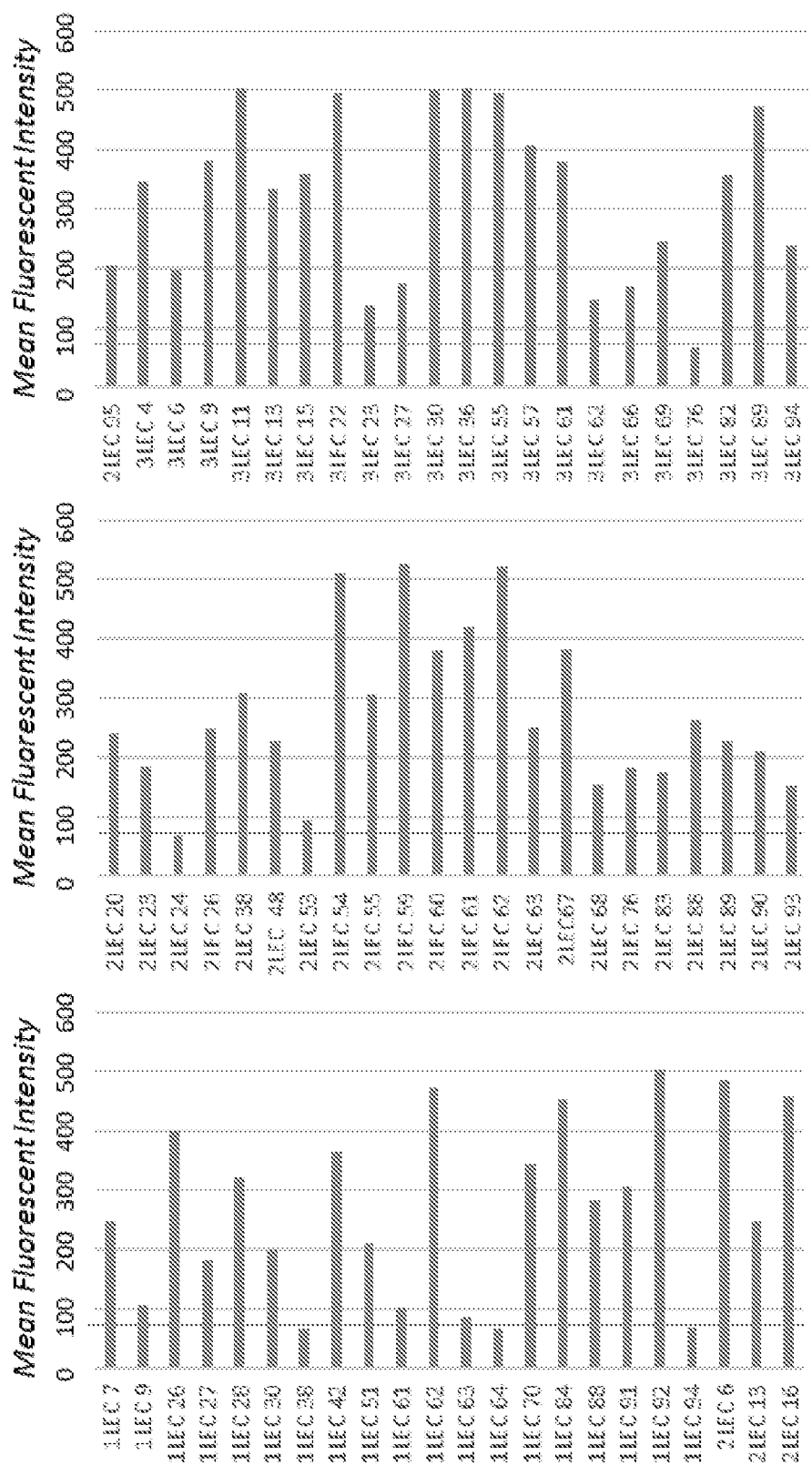
FIG. 4 shows the binding of various VHHs to Hek293 T cells transfected with human Clec9A.

The present invention is based, in part, on the discovery of agents (e.g. antibodies such as, by way of non-limiting example, VHHs) that recognize and bind to Clec9A. In some embodiments, the present Clec9A binding agents are part of a chimeric or fusion protein with one or more targeting moieties and/or one or more signaling agents. In some embodiments, these Clec9A binding agents bind to, but do not functionally modulate Clec9A.

In some embodiments, these Clec9A binding agents may bind and directly or indirectly recruit immune cells to sites in need of therapeutic action (e.g. a tumor or tumor microenvironment). In some embodiments, the Clec9A binding agents enhance tumor antigen presentation for elicitation of effective antitumor immune response.

In some embodiments, the Clec9A binding agents modulate antigen presentation. In some embodiments, the Clec9A binding agents temper the immune response to avoid or reduce autoimmunity. In some embodiments, the Clec9A binding agents provide immunosuppression. In some embodiments, the Clec9A binding agents cause an increase a ratio of Tregs to CD8+ T cells and/or CD4+ T cells in a patient. In some embodiments, the present methods relate to reduction of auto-reactive T cells in a patient.

The present invention provides pharmaceutical compositions comprising the Clec9A binding agents and their use in the treatment of various diseases, including cancer, autoimmune, and/or neurodegenerative diseases.

Clec9A Binding Agents

In various embodiments, the present Clec9A binding agent is a protein-based agent capable of specific binding to Clec9A. In various embodiments, the present Clec9A binding agent is a protein-based agent capable of specific binding to Clec9A without functional modulation (e.g., partial or full neutralization) of Clec9A. Clec9A is a group V C-type lectin-like receptor (CTLR) expressed on the surface of a subset of dendritic cells (i.e., BDCA$_3$+ dendritic cells) specialized for the uptake and processing of materials from dead cells. Clec9A recognizes a conserved component within nucleated and non-nucleated cells, exposed when cell membranes are damaged. Clec9A is expressed at the cell surface as a glycosylated dimer and can mediate endocytosis, but not phagocytosis. Clec9A possesses a cytoplasmic immunoreceptor tyrosine-based activation-like motif that can recruit Syk kinase and induce pro-inflammatory cytokine production (see Huysamen et al. (2008), JBC, 283: 16693-701).

In various embodiments, the Clec9A binding agent of the invention comprises a targeting moiety having an antigen recognition domain that recognizes an epitope present on Clec9A. In an embodiment, the antigen-recognition domain recognizes one or more linear epitopes present on Clec9A. As used herein, a linear epitope refers to any continuous sequence of amino acids present on Clec9A. In another embodiment, the antigen-recognition domain recognizes one or more conformational epitopes present on Clec9A. As used herein, a conformation epitope refers to one or more sections of amino acids (which may be discontinuous) which form a three-dimensional surface with features and/or shapes and/or tertiary structures capable of being recognized by an antigen recognition domain.

In various embodiments, the Clec9A binding agent of the present invention may bind to the full-length and/or mature forms and/or isoforms and/or splice variants and/or fragments and/or any other naturally occurring or synthetic analogs, variants, or mutants of human Clec9A. In various embodiments, the Clec9A binding agent of the invention may bind to any forms of the human Clec9A, including monomeric, dimeric, heterodimeric, multimeric and associated forms. In an embodiment, the Clec9A binding agent binds to the monomeric form of Clec9A. In another embodiment, the Clec9A binding agent binds to a dimeric form of Clec9A. In a further embodiment, the Clec9A binding agent binds to glycosylated form of Clec9A, which may be either monomeric or dimeric.

In an embodiment, the present Clec9A binding agent comprises a targeting moiety with an antigen recognition domain that recognizes one or more epitopes present on human Clec9A. In an embodiment, the human Clec9A comprises the amino acid sequence of:

(SEQ ID NO: 1)
MHEEEIYTSLQWDSPAPDTYQKCLSSNKCSGACCLVMVISCVFCMGLLTA

SIFLGVKLLQVSTIAMQQQEKLIQQERALLNFTEWKRSCALQMKYCQAFM

QNSLSSAHNSSPCPNNWIQNRESCYYVSEIWSIWHTSQENCLKEGSTLLQ

IESKEEMDFITGSLRKIKGSYDYWVGLSQDGHSGRWLWQDGSSPSPGLLP

AERSQSANQVCGYVKSNSLLSSNCSTWKYFICEKYALRSSV.

In various embodiments, the present Clec9A binding agent comprises a targeting moiety capable of specific binding. In various embodiments, the Clec9A binding agent comprises a targeting moiety having an antigen recognition domain such as an antibody or derivatives thereof. In an embodiment, the Clec9A binding agent comprises a targeting moiety which is an antibody. In various embodiments, the antibody is a full-length multimeric protein that includes two heavy chains and two light chains. Each heavy chain includes one variable region (e.g., $V_H$) and at least three constant regions (e.g., $CH_1$, $CH_2$ and $CH_3$), and each light chain includes one variable region ($V_L$) and one constant region ($C_L$). The variable regions determine the specificity of the antibody. Each variable region comprises three hypervariable regions also known as complementarity determining regions (CDRs) flanked by four relatively conserved framework regions (FRs). The three CDRs, referred to as CDR1, CDR2, and CDR3, contribute to the antibody binding specificity. In some embodiments, the antibody is a chimeric antibody. In some embodiments, the antibody is a humanized antibody.

In some embodiments, the Clec9A binding agent comprises a targeting moiety which is an antibody derivative or format. In some embodiments, the present Clec9A binding agent comprises a targeting moiety which is a single-domain antibody, a recombinant heavy-chain-only antibody (VHH), a single-chain antibody (scFv), a shark heavy-chain-only antibody (VNAR), a microprotein (cysteine knot protein, knottin), a DARPin; a Tetranectin; an Affibody; a Transbody; an Anticalin; an AdNectin; an Affilin; an Affimer, a Microbody; an aptamer; an alterase; a plastic antibody; a phylomer; a stradobody; a maxibody; an evibody; a fynomer, an armadillo repeat protein, a Kunitz domain, an avimer, an atrimer, a probody, an immunobody, a triomab, a troybody; a pepbody; a vaccibody, a UniBody; a DuoBody, a Fv, a Fab, a Fab', a F(ab')$_2$, a peptide mimetic molecule, or a synthetic molecule, as described in US Patent Nos. or Patent Publication U.S. Pat. No. 7,417,130, US 2004/132094, U.S. Pat. No. 5,831,012, US 2004/023334, U.S. Pat.

Nos. 7,250,297, 6,818,418, US 2004/209243, U.S. Pat. Nos. 7,838,629, 7,186,524, 6,004,746, 5,475,096, US 2004/146938, US 2004/157209, U.S. Pat. Nos. 6,994,982, 6,794,144, US 2010/239633, U.S. Pat. No. 7,803,907, US 2010/119446, and/or U.S. Pat. No. 7,166,697, the contents of which are hereby incorporated by reference in their entireties. See also, Storz MAbs. 2011 May-June; 3(3): 310-317.

In some embodiments, the Clec9A binding agent comprises a targeting moiety which is a single-domain antibody, such as a VHH. The VHH may be derived from, for example, an organism that produces VHH antibody such as a camelid, a shark, or the VHH may be a designed VHH. VHHs are antibody-derived therapeutic proteins that contain the unique structural and functional properties of naturally-occurring heavy-chain antibodies. VHH technology is based on fully functional antibodies from camelids that lack light chains. These heavy-chain antibodies contain a single variable domain ($V_HH$) and two constant domains (CH2 and CH3).

In an embodiment, the Clec9A binding agent comprises a VHH. In some embodiments, the VHH is a humanized VHH or camelized VHH.

In some embodiments, the VHH comprises a fully human $V_H$ domain, e.g. a HUMABODY (Crescendo Biologics, Cambridge, UK). In some embodiments, fully human $V_H$ domain, e.g. a HUMABODY is monovalent, bivalent, or trivalent. In some embodiments, the fully human $V_H$ domain, e.g. a HUMABODY is mono- or multi-specific such as monospecific, bispecific, or trispecific. Illustrative fully human $V_H$ domains, e.g. a HUMABODIES are described in, for example, WO2016/113555 and WO2016/113557, the entire disclosure of which is incorporated by reference.

In some embodiments, the Clec9A binding agent comprises a targeting moiety which is a VHH comprising a single amino acid chain having four "framework regions" or FRs and three "complementary determining regions" or CDRs. As used herein, "framework region" or "FR" refers to a region in the variable domain which is located between the CDRs. As used herein, "complementary determining region" or "CDR" refers to variable regions in VHHs that contains the amino acid sequences capable of specifically binding to antigenic targets.

In various embodiments, the Clec9A binding agent comprises a VHH having a variable domain comprising at least one CDR1, CDR2, and/or CDR3 sequences. In various embodiments, the Clec9A binding agent comprises a VHH having a variable region comprising at least one FR1, FR2, FR3, and FR4 sequences.

In some embodiments, the CDR1 sequence is selected from:

GRISSINSMG (SEQ ID NO: 2); GSITSINAMG (SEQ ID NO: 3); GRFFRVNAMG (SEQ ID NO: 4); GSSDSINAMG (SEQ ID NO: 5); GSVFSINAWG (SEQ ID NO: 6); GSILSINSMG (SEQ ID NO: 7); VSISSINSMG (SEQ ID NO: 8); GRVFSINAMG (SEQ ID NO: 9); VNIDTLNSMA (SEQ ID NO: 10); GGISSINSMG (SEQ ID NO: 11); GSMHSVNSMA (SEQ ID NO: 12); GDISSINAMG (SEQ ID NO: 13); GSIFSIDAMG (SEQ ID NO: 14); GSIFSINAMG (SEQ ID NO: 15); GSIFSIAAMG (SEQ ID NO: 16); GNIASITAMG (SEQ ID NO: 17); GFTFDDYAIG (SEQ ID NO: 18); GSISSINAMG (SEQ ID NO: 19); VSIFRSYFMG (SEQ ID NO: 20); GSIVSINAIG (SEQ ID NO: 21); RSFSSFNAMG (SEQ ID NO: 22); GSFSSINAMG (SEQ ID NO: 23); GTSFSINGMA (SEQ ID NO: 24); GRTFSTYAMG (SEQ ID NO: 25); GRIFDINAMG (SEQ ID NO: 26); GTLFSINGMA (SEQ ID NO: 27); GSIDSINAMG (SEQ ID NO: 28); GRAFSTNSMG (SEQ ID NO: 29); GSIISINSMG (SEQ ID NO: 30); RNFFSINAMG (SEQ ID NO: 31); GSIVSINSMG (SEQ ID NO: 32); GSIIGINSMG (SEQ ID NO: 33); GRTFPGYVMA (SEQ ID NO: 34); GRTFSINAMG (SEQ ID NO: 35); GRTLSSYTIG (SEQ ID NO: 36); GSFFSINAMG (SEQ ID NO: 37); GSIFSINSMG (SEQ ID NO: 38); GSIFSFNAMG (SEQ ID NO: 39); GRTFSTYAMA (SEQ ID NO: 40); VNIGSLNSMV (SEQ ID NO: 41); GRTLSNYAVG (SEQ ID NO: 42); GSVFSINAMG (SEQ ID NO: 43); GSIFEINSIG (SEQ ID NO: 44); GSIFNINSMG (SEQ ID NO: 45); VNIGTLNSMA (SEQ ID NO: 46); GRIGSINSMG (SEQ ID NO: 47); GRTLSNYAVA (SEQ ID NO: 48); RSFFSFNAMG (SEQ ID NO: 49); GIIFSINAMG (SEQ ID NO: 50); GRIFSVNAMG (SEQ ID NO: 51); GRTFSSYAMA (SEQ ID NO: 52); GSFSSINVMG (SEQ ID NO: 53); INSMG (SEQ ID NO: 54); INAMG (SEQ ID NO: 55); VNAMG (SEQ ID NO: 56); INAWG (SEQ ID NO: 57); LNSMA (SEQ ID NO: 58); VNSMA (SEQ ID NO: 59); IDAMG (SEQ ID NO: 60); IAAMG (SEQ ID NO: 61); SITAMG (SEQ ID NO: 62); DYAIG (SEQ ID NO: 63); SYFMG (SEQ ID NO: 64); INAIG (SEQ ID NO: 65); FNAMG (SEQ ID NO: 66); INGMA (SEQ ID NO: 67); TYAMG (SEQ ID NO: 68); TNSMG (SEQ ID NO: 69); GYVMA (SEQ ID NO: 70); SYTIG (SEQ ID NO: 71); TYAMA (SEQ ID NO: 72); LNSMV (SEQ ID NO: 73); NYAVG (SEQ ID NO: 74); INSIG (SEQ ID NO: 75); NYAVA (SEQ ID NO: 76); SYAMA (SEQ ID NO: 77); and INVMG (SEQ ID NO: 78).

In some embodiments, the CDR2 sequence is selected from:

AITNGGAKTYADSVKG (SEQ ID NO: 79); AITSGGRLSYADSVKG (SEQ ID NO: 80); AITNGGQTAYADSVKG (SEQ ID NO: 81); AITSGGRSTYIDSAKG (SEQ ID NO: 82); AITNQGRIAYAPSVNG (SEQ ID NO: 83); AITNDGRTTYVDSVKG (SEQ ID NO: 84); AVTVGGRYAYADSAKN (SEQ ID NO: 85); AITNQGATTYADSVKG (SEQ ID NO: 86); GITGSGQITYANSVRG (SEQ ID NO: 87); AITNGGRTVYGDSVKG (SEQ ID NO: 88); AITSGGRLAYAPSVNG (SEQ ID NO: 89); AITNGGRTTYVDSVKG (SEQ ID NO: 90); AITTGGRTTYVDSVKG (SEQ ID NO: 91); AITNQGRLTYADSVKG (SEQ ID NO: 92); AITSGGRRAYADSVKG (SEQ ID NO: 93); AITSASASRTTYADSVKG (SEQ ID NO: 94); CISRSDGSTYYDDSVKG (SEQ ID NO: 95); AITNQGRVTYADSVKG (SEQ ID NO: 96); AITDGGRLAYADSAKG (SEQ ID NO: 97); SITNQGIRNYSTSVMG (SEQ ID NO: 98); AITNQGRTTYADSVKG (SEQ ID NO: 99); AITNGGRIAYGIAVNG (SEQ ID NO: 100); AITNGGRIAYSDSAKG (SEQ ID NO: 101); GITSDGSTGYADSVKG (SEQ ID NO: 102); AISWSGGSTYYADSVKG (SEQ ID NO: 103); AITDQGRLAYADSAKG (SEQ ID NO: 104); AITNGGQTTYADSVKG (SEQ ID NO: 105); AITTGGRTAYVDSVKG (SEQ ID NO: 106); AITSQGRITLADSVKG (SEQ ID NO: 107); AITVDGRLAYADSAKH (SEQ ID NO: 108); AITNGGRIAYGTSVMG (SEQ ID NO: 109); AITNGGQIAYADSVKG (SEQ ID NO: 110); AITDQGRTTYADSVKG (SEQ ID NO: 111); GITTQGRITYGNSVRG (SEQ ID NO: 112); AITSGGRTTYVDSVKG (SEQ ID NO: 113); AINWRGGDTYYADSVKG (SEQ ID NO: 114); AITDGGAKTYADSVKG (SEQ ID NO: 115); AITNQGRLSYVDSVKG (SEQ ID NO: 116); AITNQGRRTYADSVKG (SEQ ID NO: 117); AITNGGRIAYTDSVKG (SEQ ID NO: 118); AITNGGRTTYADSVKG (SEQ ID NO: 119); AITDGGRLTYADSAKG (SEQ ID NO: 120); AISWSGGSTEYHDSVKG (SEQ ID NO: 121); AITNQGRIAYADSVKG (SEQ ID NO: 122); AINWSSGGISYSNSAKG (SEQ ID NO: 123); AITGQGRTTY-

ADSVKG (SEQ ID NO: 124); AITNGGQIVYADSVKG (SEQ ID NO: 125); AITTQGRTTYEDSVKG (SEQ ID NO: 126); AITSGGITNYANSVQG (SEQ ID NO: 127); AITVGGRLAYADSAKG (SEQ ID NO: 128); GITGGGQITYANSVRG (SEQ ID NO: 129); AITSQGRSTYADSAKG (SEQ ID NO: 130); AITNGGATVYADSVKG (SEQ ID NO: 131); AITDGGRLTYADSAKN (SEQ ID NO: 132); AINWSSGGISYSNAAKG (SEQ ID NO: 133); AITNXGRTTYADSVKG (SEQ ID NO: 134); AIWWASGGISYANSAKG (SEQ ID NO: 135); AITNQGAPTYADSVKG (SEQ ID NO: 136); RITNLGLPNYADSVTG (SEQ ID NO: 137); RITNLGLPNYADSVKG (SEQ ID NO: 138); AITNGGAKT (SEQ ID NO: 139); AITSGGRLS (SEQ ID NO: 140); AITNGGQTA (SEQ ID NO: 141); AITSGGRST (SEQ ID NO: 142); ITNQGRIA (SEQ ID NO: 143); ITNQGRIAYAPSVNG (SEQ ID NO: 144); AITNDGRTT (SEQ ID NO: 145); AVTVGGRYA (SEQ ID NO: 146); AITNQGATT (SEQ ID NO: 147); GITGSGQIT (SEQ ID NO: 148); AITNGGRTV (SEQ ID NO: 149); AITSGGRLA (SEQ ID NO: 150); AITNGGRTT (SEQ ID NO: 151); AITTGGRTT (SEQ ID NO: 152); AITNQGRLT (SEQ ID NO: 153); AITSGGRRA (SEQ ID NO: 154); AITSASASRTT (SEQ ID NO: 155); CISRSDGSTY (SEQ ID NO: 156); AITNQGRVT (SEQ ID NO: 157); AITDGGRLA (SEQ ID NO: 158); SITNQGIRN (SEQ ID NO: 159); AITNQGRTT (SEQ ID NO: 160); AITNGGRIA (SEQ ID NO: 161); GITSDGSTG (SEQ ID NO: 162); AISWSGGSTY (SEQ ID NO: 163); AITDQGRLA (SEQ ID NO: 164); AITNGGQTT (SEQ ID NO: 165); AITTGGRTA (SEQ ID NO: 166); AITSQGRIT (SEQ ID NO: 167); AITVDGRLA (SEQ ID NO: 168); AITNGGQIA (SEQ ID NO: 169); AITDQGRTT (SEQ ID NO: 170); GITTQGRIT (SEQ ID NO: 171); AITSGGRTT (SEQ ID NO: 172); AINWRGGDTY (SEQ ID NO: 173); AITDGGAKT (SEQ ID NO: 174); AITNQGRLS (SEQ ID NO: 175); AITNQGRRT (SEQ ID NO: 176); AITDGGRLT (SEQ ID NO: 177); AISWSGGSTE (SEQ ID NO: 178); AITNQGRIA (SEQ ID NO: 179); AINWSSGGIS (SEQ ID NO: 180); AITGQGRTT (SEQ ID NO: 181); AITNGGQIV (SEQ ID NO: 182); AITTQGRTT (SEQ ID NO: 183); AITSGGITN (SEQ ID NO: 184); AITVGGRLA (SEQ ID NO: 185); GITGGGQIT (SEQ ID NO: 186); AITSQGRST (SEQ ID NO: 187); AITNGGATV (SEQ ID NO: 188); AITNXGRTT (SEQ ID NO: 189); AIWWASGGIS (SEQ ID NO: 190); AITNQGAPT (SEQ ID NO: 191); and RITNLGLPN (SEQ ID NO: 192).

In some embodiments, the CDR3 sequence is selected from:
FTRRDDY (SEQ ID NO: 193); FQSSGID (SEQ ID NO: 194); WAADYQQY (SEQ ID NO: 195); WNRDRQQY (SEQ ID NO: 196); KPTPVYGSTVGDY (SEQ ID NO: 197); FTRDKDY (SEQ ID NO: 198); WDRDRQQY (SEQ ID NO: 199); FTRTDDY (SEQ ID NO: 200); YDRSSTPY (SEQ ID NO: 201); FTRGDDY (SEQ ID NO: 202); LNSATTY (SEQ ID NO: 203); YTRDEDY (SEQ ID NO: 204); FTRDEDY (SEQ ID NO: 205); KWYDPLVIEYYDN (SEQ ID NO: 206); KADHNDY (SEQ ID NO: 207); FRSGADDY (SEQ ID NO: 208); EVPSTYSCSGFREDY (SEQ ID NO: 209); FAASGMEY (SEQ ID NO: 210); WTTDRQQY (SEQ ID NO: 211); FAGWGKEDY (SEQ ID NO: 212); FSPTGDY (SEQ ID NO: 213); KPTPVYGSTVGDY (SEQ ID NO: 214); KASPVYGSTVEDY (SEQ ID NO: 215); STPRGDSY (SEQ ID NO: 216); EAEGSGREGNFYERS (SEQ ID NO: 217); WDRDRQQY (SEQ ID NO: 218); FTRSDDY (SEQ ID NO: 219); STPRGDSY (SEQ ID NO: 220); FTRDTDY (SEQ ID NO: 221); WTTLGTF (SEQ ID NO: 222); WVRDGQQY (SEQ ID NO: 223); KAIPVYGSTVEDY (SEQ ID NO: 224); KAAATHLSTVADY (SEQ ID NO: 225); FGRFDDY (SEQ ID NO: 226); WGVKTGPESGSGTL (SEQ ID NO: 227); FTRDEDY (SEQ ID NO: 228); RLTTEYDYAY (SEQ ID NO: 229); FTRGNDY (SEQ ID NO: 230); FQSSGID (SEQ ID NO: 231); FSPTDDF (SEQ ID NO: 232); KAIPIYGSTAEDY (SEQ ID NO: 233); FSLTDDY (SEQ ID NO: 234); WTRDRQQY (SEQ ID NO: 235); FTRDEDF (SEQ ID NO: 236); EVEGSGREGNFYGA (SEQ ID NO: 237); PGWDY (SEQ ID NO: 238); YDRSATAY (SEQ ID NO: 239); ASSVLSGTVDY (SEQ ID NO: 240); FAADGMEY (SEQ ID NO: 241); KAAASYVSTVADY (SEQ ID NO: 242); TAKDDY (SEQ ID NO: 243); FTGWGKEDY (SEQ ID NO: 244); WAADYQQY (SEQ ID NO: 245); YDRSATPY (SEQ ID NO: 246); WARDRQQY (SEQ ID NO: 247); WTKDRQQY (SEQ ID NO: 248); FTRTYDY (SEQ ID NO: 249); ASSILSGTVDY (SEQ ID NO: 250); WAADYQQY (SEQ ID NO: 251); KPAPVYGSTVGDY (SEQ ID NO: 252); FAADGMEY (SEQ ID NO: 253); FGSGGG (SEQ ID NO: 254); ASSVLSGTADY (SEQ ID NO: 255); VALKAEY (SEQ ID NO: 256); and EAEGSGREGNFYERS (SEQ ID NO: 257).

In various exemplary embodiments, the Clec9A binding agent comprises an amino acid sequence selected from the following sequences:

```
1LEC 7
                                                        (SEQ ID NO: 258)
QVQLQESGGGLVQPGGSLRLSCAASGRISSINSMGWYRQAPGNQRELVAAITNGGAKTYADSVKGRFTISTDNA

GNTVYLQMDSLRPEDTAVYYCKAFTRRDDYWGQGTQITVSSAAAYPYDVPDYGSHHHHHH;

1LEC 9
                                                        (SEQ ID NO: 259)
QVQLQESGGGLVQAGGSLRLSCAASGSITSINAMGWYRQAPGKQRELVAAITSGGRLSYADSVKGRFTISRDNA

ESTVALQMNSLKPEDTAVYSCAAFQSSGIDWGQGTQVTVSSAAAYPYDVPDYGSHHHHHH;

1LEC 26
                                                        (SEQ ID NO: 260)
QVQLQESGGGLVQPGGSLRLSCAASGRFFRVNAMGWYRQAPGKQRELVAAITNGGQTAYADSVKGRFTISKES

ARNTVHLQMSSLKPEDTAVYYCTIWAADYQQYWGQGTQVTVSSAAAYPYDVPDYGSHHHHHH;

1LEC 27
                                                        (SEQ ID NO: 261)
QVQLQESGGGLVQAGESLRLSCAASGSSDSINAMGWYRQAPGKQRELVAAITSGGRSTYIDSAKGRATISRDNA

RNTAYLQMSSLKAEDTAVYYCTIWNRDRQQYWGQGTQVTVSSAAAYPYDVPDYGSHHHHHH;
```

-continued

1LEC 28
(SEQ ID NO: 262)
QVQLQESGGGLVQSGGSLRLSCAASGSVFSINAWGWYRQAPGKQRELVAAITNQGRIAYAPSVNGRFTISRDS

AKNTVYLQMNSLKPEDTAVYYCNAKPTPVYGSTVGDYWGQGTQVTVSSAAAYPYDVPDYGSHHHHHH;

1LEC 30
(SEQ ID NO: 263)
QVQLQESGGGLVQAGGSLRLSCAASGSILSINSMGWYRPALGNQRELVAAITNDGRTTYVDSVKGRFTISRDNA

KNTVYLQMNSLKPEDTAVYWCKAFTRDKDYWGQGTQVTVSSAAAYPYDVPDYGSHHHHHH;

1LEC 38
(SEQ ID NO: 264)
QVQLQESGGGLVQTGGSLRLSCAASVSISSINSMGWYRQAPGKERELVAAVTVGGRYAYADSAKNRFTISRDD

AQNTVHLQMSSLRAEDTAVYYCTIWDRDRQQYWGXGTQVTVSSAAAYPYDVPDYGSHHHHHH;

1LEC 42
(SEQ ID NO: 265)
QVQLQESGGGLVQPGGSLRLSCAASGRVFSINAMGWYRQAPGKQRELVAAITNQGATTYADSVKGRFTISRDT

AGNTVYLQMNSLRPEDTAVHYCKAFTRTDDYWGQGTQVTVSSAAAYPYDVPDYGSHHHHHH;

1LEC 51
(SEQ ID NO: 266)
QVQLQESGGGLVQAGGSLRLSCAASVNIDTLNSMAWYRQAPGKQRELVAGITGSGQITYANSVRGRFTVSRDN

AKSTVYLQMNTLQPEDTAVYYCAAYDRSSTPYWGQGTQVTVSSAAAYPYDVPDYGSHHHHHH;

1LEC 61
(SEQ ID NO: 267)
QVQLQESGGGLVQPGGSLRLSCAASGGISSINSMGWYRQAPGNQRELVAAITNGGRTVYGDSVKGRFTISRDS

AGNTVHLQMDSLRPEDTGVYYCKAFTRGDDYWGQGTQVTVSSAAAYPYDVPDYGSHHHHHH;

1LEC 62
(SEQ ID NO: 268)
QVQLQESGGGLVQPGGFLSLSCAASGSMHSVNSMAWYRQVPGKQRELVAAITSGGRLAYAPSVNGRFTISRDY

AKNTIHLQMNSLEPEDTAVYYCAALNSATTYWGQGTQVTVSSAAAYPYDVPDYGSHHHHHH;

1LEC 63
(SEQ ID NO: 269)
QVQLQESGGGLVQAGGSLRLSCAATGDISSINAMGWHRPARGNERELVAAITNGGRTTYVDSVKGRFTISRDNA

KNTVYLQMNSLKPEDTAVYFCKAYTRDEDYWGQGTQVTVSSAAAYPYDVPDYGSHHHHHH;

1LEC 64
(SEQ ID NO: 270)
QVQLQESGGGLVRAGGSLRLSCAASGSIFSIDAMGWYRPAHGEQRELVAAITTGGRTTYVDSVKGRFTISRDNA

KNTVYLQMNSLKPEDTAVYFCKAFTRDEDYWGQGTQVTVSSAAAYPYDVPDYGSHHHHHH;

1LEC 70
(SEQ ID NO: 271)
QVQLQESGGGLVQPGGSLRLSCAASGSIFSINAMGWYRQAPGKQRELVAAITNQGRLTYADSVKGRFTISRDNA

KNTVFLQMDSLKPEDTAVYYCNAKWYDPLVIEYYDNWGQGTQVTVSSAAAYPYDVPDYGSHHHHHH;

1LEC 84
(SEQ ID NO: 272)
QVQLQESGGGLVQPGGSLRLSCAASGSIFSIAAMGWYRQAPGKQRELVAAITSGGRRAYADSVKGRFTISRDND

ENTVALQMNSLKPEDTDVYYCNAKADHNDYWGQGTQITVSSAAAYPYDVPDYGSHHHHHH;

1LEC 88
(SEQ ID NO: 273)
QVQLQESGGGLVQPGGSLRLSCAAIGNIASITAMGWYRQAPGKQRELVAAITSASASRTTYADSVKGRFTISRDN

AKNTVYLQMNSLQPEDTAVYYCKGFRSGADDYWGQGTQVTVSSAAAYPYDVPDYGSHHHHHH;

1LEC 91
(SEQ ID NO: 274)
QVQLQESGGGLVQPGGSLRLSCAASGFTFDDYAIGWFRQAPGKEHEGVSCISRSDGSTYYDDSVKGRFTISSD

NAKNTVYLQMNSLKPEDTAVYYCAAEVPSTYSCSGFREDYKGKGTQVTVSSAAAYPYDVPDYGSHHHHHH;

-continued

1LEC 92

(SEQ ID NO: 275)
QVQLQESGGGLVQPGGSLRLSCAASGSISSINAMGWYRQAPGNQRELVAAITNQGRVTYADSVKGRFTISRDG

AKNTVYLQMNSLKPEDTAVYYCKVFAASGMEYWGKGTQVTVSSAAAYPYDVPDYGSHHHHHH;

1LEC 94

(SEQ ID NO: 276)
QVQLQESGGGLVQAGESLRLSCAASVSIFRSYFMGWYRQAPGKQRELVAAITDGGRLAYADSAKGRFTISREDT

RNTVHLQMSSLKAEDTAVYYCTIWTTDRQQYWGQGTQVTVSSAAAYPYDVPDYGSHHHHHH;

2LEC 6

(SEQ ID NO: 277)
QVQLQESGGGWVQPGGSLRLSCAATGSIVSINAIGWYRQAPGKQRELVASITNQGIRNYSTSVMGRFTISRDDV

KNTVSLQMNSLKPEDSAVYYCKGFAGWGKEDYWGQGTQVTVSSAAAYPYDVPDYGSHHHHHH;

2LEC 13

(SEQ ID NO: 278)
QVQLQESGGGLVQAGASLRLSCAASGSIFSINAMGWYRQAPGKQRELVAAITNQGRTTYADSVKGRFTISRDNA

KNTVYLQMDSLEPEDTAIYYCKGFSPTGDYWGQGTQVTVSSAAAYPYDVPDYGSHHHHHH;

2LEC 16

(SEQ ID NO: 279)
QVQLQESGGGLVQPGGSLRLSCLASRSFSSFNAMGWYRQAPGKERELVAAITNGGRIAYGIAVNGRFTISRDNA

KNTVYLQMNSLKPEDTAVYYCNAKPTPVYGSTVGDYWGQGTQVTVSSAAAYPYDVPDYGSHHHHHH;

2LEC 20

(SEQ ID NO: 280)
QVQLQESGGGLVQAGGSLTLSCAASGSFSSINAMGYYRQAPGKQRELVAAITNGGRIAYSDSAKGRFTISRDSA

KNTMYLQMNSLKPEDTDVYYCNAKASPVYGSTVEDYWGQGTQVTVSSAAAYPYDVPDYGSHHHHHH;

2LEC 23

(SEQ ID NO: 281)
QVQLQESGGGLVQPGGSLRLSCAASGTSFSINGMAWYRQAPGGQRELVGGITSDGSTGYADSVKGRFTVSRD

NAKNTVYLQMNRLKPEDTAVYYCGTSTPRGDSYWGQGTQVTVSSAAAYPYDVPDYGSHHHHHH;

2LEC 24

(SEQ ID NO: 282)
QVQLQESGGGLVQAGGSLRLSCAASGRTFSTYAMGWFRQAPGKERGLVAAISWSGGSTYYADSVKGRFTIFRD

NAENTVYLQMNSLKPEDTAVYYCAAEAEGSGREGNFYERSWYQGQGTQVTVSSAAAYPYDVPDYGSHHHHH;

2LEC 26

(SEQ ID NO: 283)
QVQLQESGGGLVETGGSLRLSCAASGSIFSINAMGWYRQAPGKQRELVAAITDQGRLAYADSAKGRFTISRENA

RNTLHLQMSSLKAEDTAVYYCTIWDRDRQQYWGQGTQVTVSSAAAYPYDVPDYGSHHHHHH;

2LEC 38

(SEQ ID NO: 284)
QVQLQESGGGLVQPGGSLRLSCAASGRIFDINAMGWYRQAPGKQRELVAAITNGGQTTYADSVKGRFTISRDN

AGNTVYLQMNSLRPEDTAVYYCKAFTRSDDYWGQGTQVTVSSAAAYPYDVPDYGSHHHHHH;

2LEC 48

(SEQ ID NO: 285)
QVQLQESGGGLVQAGGSLRLSCAASGTLFSINGMAWYRQAPGKRRELVGGITSDGSTGYADSVKGRFTISRDN

AKNTAYLQMNSLKPEDTAVYYCGTSTPRGDSYWGQGTQVTVSSAAAYPYDVPDYGSHHHHHH;

2LEC 53

(SEQ ID NO: 286)
QVQLQESGGGLVQAGGSLRLSCAASGSIDSINAMGWYRPALGEQRELVAAITTGGRTAYVDSVKGRFTISRDAA

KNTVYLQMNSLKPEDTAVYSCKAFTRDTDYWGQGTQVTVSSAAAYPYDVPDYGSHHHHHH;

2LEC 54

(SEQ ID NO: 287)
QVQLQESGGGLAQPGGSLQLSCAASGRAFSTNSMGWYRQASGKQRELVAAITSQGRITLADSVKGRFTISSDN

TKNTVFLQMNSLKPEDTAVYYCNAWTTLGTFGGQGTQVTVSSAAAYPYDVPDYGSHHHHHH;

-continued

2LEC 55

(SEQ ID NO: 288)
QVQLQESGGGLVQTGESLSLSCAVASGSIISINSMGWYRQAPEKQRELVAAITVDGRLAYADSAKHRFTISKESA

RNTVHLHMSSLKPEDTAVYYCTIWVRDGQQYWGQGTQVTVSSAAAYPYDVPDYGSHHHHHH;

2LEC 59

(SEQ ID NO: 289)
QVQLQESGGGLVQPGGSLRLSCAVSRNFFSINAMGWYRQAPGKQRELVAAITNGGRIAYGTSVMGRFTISRDD

AKNTVDLQMNSLRPEDTAVYYCNAKAIPVYGSTVEDYWGQGTQVTVSSAAAYPYDVPDYGSHHHHHH;

2LEC 60

(SEQ ID NO: 290)
QVQLQESGGGLVQPGGSLRLSCAASGRFFRVNAMGWYRQVPGKQRELVAAITNGGQIAYADSVKGRFTISRDS

AKNTVYLQMNSLKSEDTDVYYCNAKAAATHLSTVADYWGQGTQVTVSSAAAYPYDVPDYGSHHHHHH;

2LEC 61

(SEQ ID NO: 291)
QVQLQESGGGLVQPGGSLRLSCAASGSIVSINSMGWYRQAPGKQRELVAAITDQGRTTYADSVKGRFTISRDDA

KNKNTVYLQMNSLKAEDTAVYACKAFGRFDDYWGQGTQVTVSSAAAYPYDVPDYGSHHHHHH;

2LEC 62

(SEQ ID NO: 292)
QVQLQESGGGLVQPGGSLRLSCAAYGSIFSINAMGWYRQAPGKERELVAGITTQGRITYGNSVRGRFTISGDNA

KNTVYLQMKSLKPEDTAVYYCSAWGVKTGPESGSGTLEGQGTQVTVSSAAAYPYDVPDYGSHHHHHH;

2LEC 63

(SEQ ID NO: 293)
QVQLQESGGGLVQAGGSLRLSCAASGSIIGINSMGYYRTAPGKQRELVAAITSGGRTTYVDSVKGRFTISRDNAK

NTVYLQMNSLKPEDTAVYFCKAFTRDEDYWGQGTQVTVSSAAAYPYDVPDYGSHHHHHH;

2LEC 67

(SEQ ID NO: 294)
QVQLQESGGGLVQAGGSLRLSCAASGRTFPGYVMAWFRQSPGQEREFAAAINWRGGDTYYADSVKGRFTISR

DNVKNTVFLQMNSLKPEDTAVYFCAARLTTEYDYAYWGQGTQVTVSSAAAYPYDVPDYGSHHHHHH;

2LEC 68

(SEQ ID NO: 295)
QVQLQESGGGLVQPGESLRLSCAASGSIFSINAMGWYRQAPGKQRELVAAITDGGAKTYADSVKGRFTISTDNA

GNTVYLQMDSLRPEDTAVYYCKAFTRGNDYWGQGTQVTVSSAAAYPYDVPDYGSHHHHHH;

2LEC 76

(SEQ ID NO: 296)
QVQLQESGGGLVQAGESLRLSCVVSGRTFSINAMGWYRQAPGKQRELVAAITNQGRLSYVDSVKGRFTISRDN

AANTVYLQMNSLKPEDTAVYYCAAFQSSGIDWGQGTQVTVSSAAAYPYDVPDYGSHHHHHH;

2LEC 83

(SEQ ID NO: 297)
QVQLQESGGGLVQAGGSLRLSCAASGRTLSSYTIGWYRQAPGKQRELVAAITNQGRRTYADSVKGRFTISRDN

AKNTVYLQMDSLKSEDTAVYYCKGFSPTDDFWGQGTQVTVSSAAAYPYDVPDYGSHHHHHH;

2LEC 88

(SEQ ID NO: 298)
QVQLQESGGGLVQPGGSLRLSCTASGSFFSINAMGWYRQAPGNQRELVAAITNGGRIAYTDSVKGRFTISNDNA

KNTVYLQMNSLKPEDTDVYYCNAKAIPIYGSTAEDYWGQGTQVTVSSAAAYPYDVPDYGSHHHHHH;

2LEC 89

(SEQ ID NO: 299)
QVQLQESGGGLVQAGGSLRLSCAASGSIFSINSMGWYRQAPGKQRELVAAITNGGRTTYADSVKGRFTISRDNA

KNTVYLQMDSLKPEDTAVYYCKGFSLTDDYWGQGTQVTVSSAAAYPYDVPDYGSHHHHHH;

2LEC 90

(SEQ ID NO: 300)
QVQLQESGGGLVQTGGSLRLSCAASGSIFSFNAMGWYRQAPGKQRELVAAITDGGRLTYADSAKGRFTISRENT

RNTVHLQMSSLKAEDTADYYCTIWTRDRQQYWGQGTQVTVSSAAAYPYDVPDYGSHHHHHH;

2LEC 93

(SEQ ID NO: 301)
QVQLQESGGGLVQAGGSLRLSCAASGSIFSINAMGWYRPALGEQRELVAAITTGGRTTYVDSVKGRFSISRDNA

KNTVYLQMNSLKPEDTAVYFCKAFTRDEDFWGQGTQVTVSSAAAYPYDVPDYGSHHHHHH;

2LEC 95

(SEQ ID NO: 302)
QVQLQESGGGLVQAGGSLRLSCEASGRTFSTYAMAWFRQAPGKERDLVAAISWSGGSTEYHDSVKGRFTISRD

NTKNTVYLQMNSLKAEDTAVYYCAAEVEGSGREGNFYGASWYPGQGTQVTVSSAAAYPYDVPDYGSHHHHH;

3LEC 4

(SEQ ID NO: 303)
QVQLQESGGGLVQPGGSLRLSCAASGSFFSINAMGWYRQAPGKQRELVAAITNQGRIAYADSVKGRFTISRDNA

KNTVYLQMNSLKPEDTAVYYCGRPGWDYWGQGTQVTVSSAAAYPYDVPDYGSHHHHHH;

3LEC 6

(SEQ ID NO: 304)
QVQLQESGGGLVQAGGSLRLSCVASVNIGSLNSMVWYRQSPGKQRELVAGITGSGQITYANSVRGRFTVSRDIA

KSTAYLQMNTLKPEDTAVYYCAAYDRSATAYWGQGTQVTVSSAAAYPYDVPDYGSHHHHHH;

3LEC 9

(SEQ ID NO: 305)
QVQLQESGGGLVQAGGSLRVSCAASGRTLSNYAVGWWRQAPGKQREFVAAINWSSGGISYSNSAKGRFALSR

DNAKNTVYLQMDSLKPEDTAVYYCAAASSVLSGTVDYWGQGTQVTVSSAAAYPYDVPDYGSHHHHHH;

3LEC 11

(SEQ ID NO: 306)
QVQLQESGGGLVQPGGSLRLSCAASGSISSINAMGWYRQAPGKQRELVAAITGQGRTTYADSVKGRFTISRDG

AKNTVYLQMNSLKPEDTAVYYCKVFAADGMEYWGKGTQVTVSSAAAYPYDVPDYGSHHHHHH;

3LEC 13

(SEQ ID NO: 307)
QVQLQESGGGLVQPGGSLRLSCAASGRFFRVNAMGWYRQAPGKQRELVAAITNGGQIVYADSVKGRFTISRDS

AKNTVYLQMNSLKSEDTAVYYCNAKAAASYVSTVADYWGQGTQVTVSSAAAYPYDVPDYGSHHHHHH;

3LEC 15

(SEQ ID NO: 308)
QVQLQESGGGLVQAGGSLRLSCAASGSVFSINAMGWYRQAPEKQRELVAAITTQGRTTYEDSVKGRFTISRDG

AQNTVYLQMDSLKPEDTAVYYCKAWTAKDDYWGKGTQVTVSSAAAYPYDVPDYGSHHHHHH;

3LEC 22

(SEQ ID NO: 309)
QVQLQESGGGRVQPGGSLRLSCAAIGSIFEINSIGWYRQAPGKQRELVAAITSGGITNYANSVQGRSTISRDNVN

NTVYLQMNSLKPEDSAVYYCKGFTGWGKEDYWGQGTQVTVSSAAAYPYDVPDYGSHHHHHH;

3LEC 23

(SEQ ID NO: 310)
QVQLQESGGGLVQTGGSLRLSCAASGSIFNINSMGWYRQAPGKQRELVAAITVGGRLAYADSAKGRFTISKESA

RNTVHLQMSSLKPEDTAVYYCTIWAADYQQYWGQGTQVTVSSAAAYPYDVPDYGSHHHHHH;

3LEC 27

(SEQ ID NO: 311)
QVQLQESGGGLVQAGGSLRLSCAASVNIGTLNSMAWYREAPGKQRELVAGITGGGQITYANSVRGRFTVSRDIA

KSTAYLQMNTLKPEDTAVYYCAAYDRSATPYWGQGTQVTVSSAAAYPYDVPDYGSHHHHHH;

3LEC 30

(SEQ ID NO: 312)
QVQLQESGGGLVQTGGSLRLSCAASGSIFSINSMGWYRQAPGKQRELVAAITSQGRSTYADSAKGRFTISLGNA

RNTVNLQMSSLKTEDTAVYYCTIWARDRQQYWGQGTQVTVSSAAAYPYDVPDYGSHHHHHH;

3LEC 36

(SEQ ID NO: 313)
QVQLQESGGGLVQPGGSLRLSCAASGRIGSINSMGWYRQAPGKQREMVAAITNGGATVYADSVKGRFTISRDN

AGNTVDLHMNSLRPEDSAVYYCKAFTRGDDYWGQGTQVTVSSAAAYPYDVPDYGSHHHHHH;

3LEC 55

(SEQ ID NO: 314)
QVQLQESGGGLVQPGGSLKLSCAASGSIFSFNAMGWYRQAPGKQRELVAAITDGGRLTYADSAKNRFTISRENT

RNTVHLQMSSLKAEDTAVYYCTIWTKDRQQYWGQGTQVTVSSAAAYPYDVPDYGSHHHHHH;

3LEC 57

(SEQ ID NO: 315)
QVQLQESGGGLVQPGGSLRLSCAASGRISSINSMGWYRQAPGKQRELVAAITNGGAKTYADSVKGRFTISRDG

AGNTVYLQMDNLRPEDTAVYYCKAFTRTYDYWGQGTQVTVSSAAAYPYDVPDYGSHHHHHH;

3LEC 61

(SEQ ID NO: 316)
QVQLQESGGGLVQAGGSLRVSCAASGRTLSNYAVAWFRQAPGKQREFVAAINWSSGGISYSNAAKGRFALSR

DNAKNTVYLQMDSLKPEDTAVYYCAAASSILSGTVDYWGQGTQVTVSSAAAYPYDVPDYGSHHHHHH;

3LEC 62

(SEQ ID NO: 317)
QVQLQESGGGLVQPGGSLRLSCAASGRIGSINSMGWYRQAPGKQREMVAAITNGGATVYADSVKGRFTISRDN

AGNTVDLHMNSLRPEDSAVYYCTIWAADYQQYWGQGTQVTVSSAAAYPYDVPDYGSHHHHHH;

3LEC 66

(SEQ ID NO: 318)
QVQLQESGGGLVQPGGSLRLSCAASRSFFSFNAMGWYRQAPGKQRELVAAITNGGRIAYGTSVMGRFTISRDN

AKNTVYLQMDSLKPEDTAVYYCNAKPAPVYGSTVGDYWGQGTQVTVSSAAAYPYDVPDYGSHHHHHH;

3LEC 69

(SEQ ID NO: 319)
QVQLQESGGGLVQPGGSPRLSCAASGRFFRVNAMGWYRQAPGKQRELVAAITNGGQTAYADSVKGRFTISRD

SAKNTVYLQMNSLKSEDTAVYYCKVFAADGMEYWGKGTQVTVSSAAAYPYDVPDYGSHHHHHH;

3LEC 76

(SEQ ID NO: 320)
QVQLQESGGGLVQPGESLRLSCAASGIIFSINAMGWYRQAPGKQRELVAAITNXGRTTYADSVKGRFTISRDNAK

NTVTLQMNSLKPEDTAVYYCNAFGSGGGVGQGTQVTVSSAAAYPYDVPDYGSHHHHHH;

3LEC 82

(SEQ ID NO: 321)
QVQLQESGGGLVQAGGSLRLSCAASGRTLSNYAVAWFRQAPGKQRELVAAIWWASGGISYANSAKGRFVLSR

DNAKNTVYLQMDSLKPEDTAVYYCAAASSVLSGTADYWGQGTQVTVSSAAAYPYDVPDYGSHHHHHH;

3LEC 89

(SEQ ID NO: 322)
QVQLQESGGGLVQPGGSLRLSCAASGRIFSVNAMGWYRQAPGKQRELVAAITNQGAPTYADSVKGRFTISRDN

AGNTVYLQMNSLRPEDTAVYYCKAFTRGDDYWGQGTQVTVSSAAAYPYDVPDYGSHHHHHH;
or

3LEC 94

(SEQ ID NO: 323)
QVQLQESGGGSVQAGGSLRLSCAASGRTFSSYAMAWFRQAPGMERELVAAISWSGGSTYYADSVKGRFTISR

DNAENTVYLQMNSLKPEDTAVYYCAAEAEGSGREGNFYERSWYQGQGTQVTVSSAAAYPYDVPDYGSHHHHH

H.

In various exemplary embodiments, the Clec9A binding agent comprises an amino acid sequence selected from any one of the sequences provided above without the terminal histidine tag sequence (i.e., HHHHHH; SEQ ID NO: 324).

In some embodiments, the Clec9A targeting moiety comprises an amino acid sequence selected from SEQ ID Nos: 258-323 (provided above) without the HA tag (i.e., YPYDVPDYGS; SEQ ID NO: 325).

In some embodiments, the Clec9A targeting moiety comprises an amino acid sequence selected from SEQ ID Nos: 258-323 (provided above) without the AAA linker (i.e., AAA).

In some embodiments, the Clec9A targeting moiety comprises an amino acid sequence selected from SEQ ID Nos: 258-323 (provided above) without the AAA linker, HA tag, and terminal histidine tag sequence (i.e., AAAY-PYDVPDYGSHHHHHH; SEQ ID NO: 326).

In various exemplary embodiments, the Clec9A binding agent comprises an amino acid sequence selected from the following sequences:

R1CHCL50:

(SEQ ID NO: 327)
QVQLVESGGGLVHPGGSLRLSCAASGSFSSINVMGWYRQAPGKERELVAR

-continued

ITNLGLPNYADSVTGRFTISRDNAKNTVYLQMNSLKPEDTAVYYCYLVAL

KAEYWGQGTQVTVSS;

R1CHCL50_opt1 (E1D-A74S-K83R-Q108L):
(SEQ ID NO: 328)
DVQLVESGGGLVHPGGSLRLSCAASGSFSSINVMGWYRQAPGKERELVAR

ITNLGLPNYADSVTGRFTISRDNSKNTVYLQMNSLRPEDTAVYYCYLVAL

KAEYWGQGTLVTVSS;

R1CHCL50_opt2 (E1D-A74S-K83R-Q108L-H13Q):
(SEQ ID NO: 329)
DVQLVESGGGLVQPGGSLRLSCAASGSFSSINVMGWYRQAPGKERELVAR

ITNLGLPNYADSVTGRFTISRDNSKNTVYLQMNSLRPEDTAVYYCYLVAL

KAEYWGQGTLVTVSS;

R1CHCL50_opt3 (E1D-A74S-K83R-Q108L-T64K):
(SEQ ID NO: 330)
DVQLVESGGGLVHPGGSLRLSCAASGSFSSINVMGWYRQAPGKERELVAR

ITNLGLPNYADSVKGRFTISRDNSKNTVYLQMNSLRPEDTAVYYCYLVAL

KAEYWGQGTLVTVSS;

R1CHCL50_opt4 (E1D-A74S-K83R-Q108L-H13Q-T64K):
(SEQ ID NO: 331)
DVQLVESGGGLVQPGGSLRLSCAASGSFSSINVMGWYRQAPGKERELVAR

ITNLGLPNYADSVKGRFTISRDNSKNTVYLQMNSLRPEDTAVYYCYLVAL

KAEYWGQGTLVTVSS;

3LEC_89 (wild type):
(SEQ ID NO: 332)
QVQLQESGGGLVQPGGSLRLSCAASGRIFSVNAMGWYRQAPGKQRELVAA

ITNQGAPTYADSVKGRFTISRDNAGNTVYLQMNSLRPEDTAVYYCKAFTR

GDDYWGQGTQVTVSS;

3LEC_89_opt1 (E1D-Q5V-Q108L):
(SEQ ID NO: 333)
DVQLVESGGGLVQPGGSLRLSCAASGRIFSVNAMGWYRQAPGKQRELVAA

ITNQGAPTYADSVKGRFTISRDNAGNTVYLQMNSLRPEDTAVYYCKAFTR

GDDYWGQGTLVTVSS;

3LEC_89_opt2 (E1D-Q5V-Q108L-A74S):
(SEQ ID NO: 334)
DVQLVESGGGLVQPGGSLRLSCAASGRIFSVNAMGWYRQAPGKQRELVAA

ITNQGAPTYADSVKGRFTISRDNSGNTVYLQMNSLRPEDTAVYYCKAFTR

GDDYWGQGTLVTVSS;

3LEC_89_opt3 (E1D-Q5V-Q108L-G75K):
(SEQ ID NO: 335)
DVQLVESGGGLVQPGGSLRLSCAASGRIFSVNAMGWYRQAPGKQRELVAA

ITNQGAPTYADSVKGRFTISRDNAKNTVYLQMNSLRPEDTAVYYCKAFTR

GDDYWGQGTLVTVSS;
and

3LEC_89_opt4 (E1D-Q5V-Q108L-A74S-G75K):
(SEQ ID NO: 336)
DVQLVESGGGLVQPGGSLRLSCAASGRIFSVNAMGWYRQAPGKQRELVAA

ITNQGAPTYADSVKGRFTISRDNSKNTVYLQMNSLRPEDTAVYYCKAFTR

GDDYWGQGTLVTVSS.

In an embodiment, the targeting moiety comprises the anti-Clec9A antibody as disclosed in Tullett et al., JCI Insight. 2016; 1(7):e87102, the entire disclosures of which are hereby incorporated by reference.

In various embodiments, the present invention contemplates the use of any natural or synthetic analogs, mutants, variants, alleles, homologs and orthologs (herein collectively referred to as "analogs") of the Clec9A binding agent of the invention as described herein. In various embodiments, the amino acid sequence of the Clec9A binding agent further includes an amino acid analog, an amino acid derivative, or other non-classical amino acids.

In various embodiments, the Clec9A binding agent comprises a targeting moiety comprising a sequence that is at least 60% identical to any one of the sequences disclosed herein. For example, the Clec9A binding agent may comprise a targeting moiety comprising a sequence that is at least about 60%, at least about 61%, at least about 62%, at least about 63%, at least about 64%, at least about 65%, at least about 66%, at least about 67%, at least about 68%, at least about 69%, at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or 100% identical to any of the sequences disclosed herein (e.g. about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, about 99% or about 100% sequence identity to any one of the sequences disclosed herein, e.g., SEQ ID NOs: 327-336).

In various embodiments, the Clec9A binding agent comprises a targeting moiety comprising an amino acid sequence having one or more amino acid mutations with respect to any one of the sequences disclosed herein. In various embodiments, the Clec9A binding agent comprises a targeting moiety comprising an amino acid sequence having one, or two, or three, or four, or five, or six, or seen, or eight, or nine, or ten, or fifteen, or twenty amino acid mutations with respect to any one of the sequences disclosed herein. In some embodiments, the one or more amino acid mutations may be independently selected from substitutions, insertions, deletions, and truncations.

In some embodiments, the amino acid mutations are amino acid substitutions, and may include conservative and/or non-conservative substitutions.

"Conservative substitutions" may be made, for instance, on the basis of similarity in polarity, charge, size, solubility, hydrophobicity, hydrophilicity, and/or the amphipathic nature of the amino acid residues involved. The 20 naturally occurring amino acids can be grouped into the following six standard amino acid groups: (1) hydrophobic: Met, Ala, Val, Leu, Ile; (2) neutral hydrophilic: Cys, Ser, Thr; Asn, Gln; (3) acidic: Asp, Glu; (4) basic: His, Lys, Arg; (5) residues that influence chain orientation: Gly, Pro; and (6) aromatic: Trp, Tyr, Phe.

As used herein, "conservative substitutions" are defined as exchanges of an amino acid by another amino acid listed within the same group of the six standard amino acid groups shown above. For example, the exchange of Asp by Glu retains one negative charge in the so modified polypeptide. In addition, glycine and proline may be substituted for one another based on their ability to disrupt α-helices.

As used herein, "non-conservative substitutions" are defined as exchanges of an amino acid by another amino acid listed in a different group of the six standard amino acid groups (1) to (6) shown above.

In various embodiments, the substitutions may also include non-classical amino acids. Exemplary non-classical amino acids include, but are not limited to, selenocysteine, pyrrolysine, N-formylmethionine β-alanine, GABA and δ-Aminolevulinic acid, 4-aminobenzoic acid (PABA), D-isomers of the common amino acids, 2,4-diaminobutyric acid, α-amino isobutyric acid, 4-aminobutyric acid, Abu, 2-amino butyric acid, γ-Abu, ε-Ahx, 6-amino hexanoic acid, Aib, 2-amino isobutyric acid, 3-amino propionic acid, ornithine, norleucine, norvaline, hydroxyproline, sarcosme, citrulline, homocitrulline, cysteic acid, t-butylglycine, t-butylalanine, phenylglycine, cyclohexylalanine, β-alanine, fluoro-amino acids, designer amino acids such as p methyl amino acids, C α-methyl amino acids, N α-methyl amino acids, and amino acid analogs in general.

In various embodiments, the amino acid mutation may be in the CDRs of the targeting moiety (e.g., the CDR1, CDR2 or CDR3 regions). In another embodiment, amino acid alteration may be in the framework regions (FRs) of the targeting moiety (e.g., the FR1, FR2, FR3, or FR4 regions).

Modification of the amino acid sequences may be achieved using any known technique in the art e.g., site-directed mutagenesis or PCR based mutagenesis. Such techniques are described, for example, in Sambrook et al., Molecular Cloning: A Laboratory Manual, Cold Spring Harbor Press, Plainview, N.Y., 1989 and Ausubel et al., Current Protocols in Molecular Biology, John Wiley & Sons, New York, N.Y., 1989.

In various embodiments, the mutations do not substantially reduce the present Clec9A binding agent's capability to specifically bind to Clec9A. In various embodiments, the mutations do not substantially reduce the present Clec9A binding agent's capability to specifically bind to Clec9A and without functionally modulating (e.g., partially or fully neutralizing) Clec9A.

In various embodiments, the binding affinity of the Clec9A binding agent of the invention for the full-length and/or mature forms and/or isoforms and/or splice variants and/or fragments and/or monomeric and/or dimeric forms and/or any other naturally occurring or synthetic analogs, variants, or mutants (including monomeric and/or dimeric forms) of human Clec9A may be described by the equilibrium dissociation constant ($K_D$). In various embodiments, the Clec9A binding agent comprises a targeting moiety that binds to the full-length and/or mature forms and/or isoforms and/or splice variants and/or fragments and/or any other naturally occurring or synthetic analogs, variants, or mutants (including monomeric and/or dimeric forms) of human Clec9A with a $K_D$ of less than about 1 µM, about 900 nM, about 800 nM, about 700 nM, about 600 nM, about 500 nM, about 400 nM, about 300 nM, about 200 nM, about 100 nM, about 90 nM, about 80 nM, about 70 nM, about 60 nM, about 50 nM, about 40 nM, about 30 nM, about 20 nM, about 10 nM, or about 5 nM, or about 1 nM.

In various embodiments, the Clec9A binding agent comprises a targeting moiety that binds but does not functionally modulate (e.g., partially or fully neutralize) the antigen of interest, i.e., Clec9A. For instance, in various embodiments, the targeting moiety of the Clec9A binding agent simply targets the antigen but does not substantially functionally modulate (e.g. partially or fully inhibit, reduce or neutralize) a biological effect that the antigen has. In various embodiments, the targeting moiety of the Clec9A binding agent binds an epitope that is physically separate from an antigen site that is important for its biological activity (e.g. an antigen's active site).

Such binding without significant function modulation finds use in various embodiments of the present invention, including methods in which the present Clec9A binding agent is used to directly or indirectly recruit active immune cells to a site of need via an effector antigen. For example, in various embodiments, the present Clec9A binding agent may be used to directly or indirectly recruit dendritic cells via Clec9A to a tumor cell in a method of reducing or eliminating a tumor (e.g. the Clec9A binding agent may comprise a targeting moiety having an anti-Clec9A antigen recognition domain and a targeting moiety having a recognition domain (e.g. antigen recognition domain) directed against a tumor antigen or receptor). In such embodiments, it is desirable to directly or indirectly recruit dendritic cells but not to functionally modulate or neutralize the Clec9A activity. In these embodiments, Clec9A signaling is an important piece of the tumor reducing or eliminating effect.

In some embodiments, the Clec9A binding agent enhances antigen-presentation by dendritic cells. For example, in various embodiments, the present Clec9A binding agent directly or indirectly recruits dendritic cells via Clec9A to a tumor cell, where tumor antigens are subsequently endocytosed and presented on the dendritic cell for induction of potent humoral and cytotoxic T cell responses.

In other embodiments (for example, related to treating autoimmune or neurodegenerative disease), the Clec9A binding agent comprises a targeting moiety that binds and neutralizes the antigen of interest, i.e., Clec9A. For instance, in various embodiments, the present methods may inhibit or reduce Clec9A signaling or expression, e.g. to cause a reduction in an immune response.

Therapeutic Agents Comprising the Present Clec9A Binding Agents

Chimeras and Fusions with Signaling Agents

In various embodiments, the Clec9A binding agent of the invention is part of a chimera or fusion with one or more signaling agents. Accordingly, the present invention provides for chimeric or fusion proteins that include, for example, a targeting moiety against Clec9A and one or more signaling agents.

In various embodiments, the signaling agent is modified to have reduced affinity or activity for one or more of its receptors, which allows for attenuation of activity (inclusive of agonism or antagonism) and/or prevents non-specific signaling or undesirable sequestration of the chimeric or fusion protein. In various embodiments, the signaling agent is antagonistic in its wild type form and bears one or more mutations that attenuate its antagonistic activity.

In various embodiments, the signaling agent is antagonistic due to one or more mutations, e.g. an agonistic signaling agent is converted to an antagonistic signaling agent and, such a converted signaling agent, optionally, also bears one or more mutations that attenuate its antagonistic activity (e.g. as described in WO 2015/007520, the entire contents of which are hereby incorporated by reference).

Accordingly, in various embodiments, the signaling agent is a modified (e.g. mutant) form of the signaling agent having one or more modifications (e.g. mutations). In various embodiments, the mutations allow for the modified signaling agent to have one or more of attenuated activity such as one or more of reduced binding affinity, reduced endogenous activity, and reduced specific bioactivity relative to unmutated, i.e. the wild type form of the signaling agent (e.g. comparing the same signaling agent in a wild type form versus a modified (e.g. mutant) form). In some embodiments, the mutations which attenuate or reduce binding or affinity include those mutations which substantially reduce or ablate binding or activity. In some embodiments, the mutations which attenuate or reduce binding or affinity are different than those mutations which substantially reduce or ablate binding or activity.

Consequentially, in various embodiments, the mutations allow for the signaling agent to have improved safety, e.g. reduced systemic toxicity, reduced side effects, and reduced off-target effects relative to unmutated, i.e. wild type, signaling agent (e.g. comparing the same signaling agent in a wild type form versus a modified (e.g. mutant) form).

As described herein, the agent may have improved safety due to one of more modifications, e.g. mutations. In various embodiments, improved safety means that the present chimeric protein provides lower toxicity (e.g. systemic toxicity and/or tissue/organ-associated toxicities); and/or lessened or substantially eliminated side effects; and/or increased tolerability, lessened or substantially eliminated adverse events; and/or reduced or substantially eliminated off-target effects; and/or an increased therapeutic window.

In various embodiments, the signaling agent is modified to have one or more mutations that reduce its binding affinity or activity for one or more of its receptors. In some embodiments, the signaling agent is modified to have one or more mutations that substantially reduce or ablate binding affinity or activity for the receptors. In some embodiments, the activity provided by the wild type signaling agent is agonism at the receptor (e.g. activation of a cellular effect at a site of therapy). For example, the wild type signaling agent may activate its receptor. In such embodiments, the mutations result in the modified signaling agent to have reduced or ablated activating activity at the receptor. For example, the mutations may result in the modified signaling agent to deliver a reduced activating signal to a target cell or the activating signal could be ablated. In some embodiments, the activity provided by the wild type signaling agent is antagonism at the receptor (e.g. blocking or dampening of a cellular effect at a site of therapy). For example, the wild type signaling agent may antagonize or inhibit the receptor. In these embodiments, the mutations result in the modified signaling agent to have a reduced or ablated antagonizing activity at the receptor. For example, the mutations may result in the modified signaling agent to deliver a reduced inhibitory signal to a target cell or the inhibitory signal could be ablated. In various embodiments, the signaling agent is antagonistic due to one or more mutations, e.g. an agonistic signaling agent is converted to an antagonistic signaling agent (e.g. as described in WO 2015/007520, the entire contents of which are hereby incorporated by reference) and, such a converted signaling agent, optionally, also bears one or mutations that reduce its binding affinity or activity for one or more of its receptors or that substantially reduce or ablate binding affinity or activity for one or more of its receptors.

In some embodiments, the reduced affinity or activity at the receptor is restorable by attachment with one or more of the targeting moieties as described herein (e.g., targeting moiety against Clec9A). In other embodiments, the reduced affinity or activity at the receptor is not substantially restorable by the activity of one or more of the targeting moieties.

In various embodiments, the chimeric proteins of the present invention reduce off-target effects because their signaling agents have mutations that weaken or ablate binding affinity or activity at a receptor. In various embodiments, this reduction in side effects is observed relative with, for example, the wild type signaling agents.

In various embodiments, the signaling agent is active on target cells because the targeting moiety(ies) compensates for the missing/insufficient binding (e.g., without limitation and/or avidity) required for substantial activation. In various embodiments, the modified signaling agent is substantially inactive en route to the site of therapeutic activity and has its effect substantially on specifically targeted cell types which greatly reduces undesired side effects.

In some embodiments, the signaling agent may include one or more mutations that attenuate or reduce binding or affinity for one receptor (i.e., a therapeutic receptor) and one or more mutations that substantially reduce or ablate binding or activity at a second receptor. In such embodiments, these mutations may be at the same or at different positions (i.e., the same mutation or multiple mutations). In some embodiments, the mutation(s) that reduce binding and/or activity at one receptor is different than the mutation(s) that substantially reduce or ablate at another receptor. In some embodiments, the mutation(s) that reduce binding and/or activity at one receptor is the same as the mutation(s) that substantially reduce or ablate at another receptor. In some embodiments, the present chimeric proteins have a modified signaling agent that has both mutations that attenuate binding and/or activity at a therapeutic receptor and therefore allow for a more controlled, on-target therapeutic effect (e.g. relative wild type signaling agent) and mutations that substantially reduce or ablate binding and/or activity at another receptor and therefore reduce side effects (e.g. relative to wild type signaling agent).

In some embodiments, the substantial reduction or ablation of binding or activity is not substantially restorable with a targeting moiety (e.g., a targeting moiety against Clec9A or any other targeting moiety described herein). In some embodiments, the substantial reduction or ablation of binding or activity is restorable with a targeting moiety. In various embodiments, substantially reducing or ablating binding or activity at a second receptor also may prevent deleterious effects that are mediated by the other receptor. Alternatively, or in addition, substantially reducing or ablating binding or activity at the other receptor causes the therapeutic effect to improve as there is a reduced or eliminated sequestration of the therapeutic chimeric proteins away from the site of therapeutic action. For instance, in some embodiments, this obviates the need of high doses of the present chimeric proteins that compensate for loss at the other receptor. Such ability to reduce dose further provides a lower likelihood of side effects.

In various embodiments, the modified signaling agent comprises one or more mutations that cause the signaling agent to have reduced, substantially reduced, or ablated affinity, e.g. binding (e.g. $K_D$) and/or activation (for instance, when the modified signaling agent is an agonist of its receptor, measurable as, for example, $K_A$ and/or $EC_{50}$) and/or inhibition (for instance, when the modified signaling agent is an antagonist of its receptor, measurable as, for example, $K_I$ and/or $IC_{50}$), for one or more of its receptors. In various embodiments, the reduced affinity at the immunomodulating agent's receptor allows for attenuation of activity (inclusive of agonism or antagonism). In such embodiments, the modified signaling agent has about 1%, or about 3%, about 5%, about 10%, about 15%, about 20%, about 25%, about 30%, about 35%, about 40%, about 45%, about 50%, about 60%, about 65%, about 70%, about 75%, about 80%, about 85%, about 90%, about 95%, or about 10%-20%, about 20%-40%, about 50%, about 40%-60%, about 60%-80%, about 80%-100% of the affinity for the receptor relative to the wild type signaling agent. In some embodiments, the binding affinity is at least about 2-fold lower, about 3-fold lower, about 4-fold lower, about 5-fold lower, about 6-fold lower, about 7-fold lower, about 8-fold lower, about 9-fold lower, at least about 10-fold lower, at least about 15-fold lower, at least about 20-fold lower, at least about 25-fold lower, at least about 30-fold lower, at least about 35-fold lower, at least about 40-fold lower, at least about 45-fold lower, at least about 50-fold lower, at least about 100-fold lower, at least about 150-fold lower, or about 10-50-fold lower, about 50-100-fold lower, about 100-150-fold lower, about 150-200-fold lower, or more than 200-fold lower relative to the wild type signaling agent.

In embodiments wherein the modified signaling agent has mutations that reduce binding at one receptor and substantially reduce or ablate binding at a second receptor, the attenuation or reduction in binding affinity of a modified signaling agent for one receptor is less than the substantial reduction or ablation in affinity for the other receptor. In some embodiments, the attenuation or reduction in binding affinity of a modified signaling agent for one receptor is less than the substantial reduction or ablation in affinity for the other receptor by about 1%, or about 3%, about 5%, about 10%, about 15%, about 20%, about 25%, about 30%, about 35%, about 40%, about 45%, about 50%, about 60%, about 65%, about 70%, about 75%, about 80%, about 85%, about 90%, or about 95%. In various embodiments, substantial reduction or ablation refers to a greater reduction in binding affinity and/or activity than attenuation or reduction.

In various embodiments, the modified signaling agent comprises one or more mutations that reduce the endogenous activity of the signaling agent to about 75%, or about 70%, or about 60%, or about 50%, or about 40%, or about 30%, or about 25%, or about 20%, or about 10%, or about 5%, or about 3%, or about 1%, e.g., relative to the wild type signaling agent.

In some embodiments, the modified signaling agent comprises one or more mutations that cause the signaling agent to have reduced affinity for its receptor that is lower than the binding affinity of the targeting moiety(ies) for its(their) receptor(s). In some embodiments, this binding affinity differential is between signaling agent/receptor and targeting moiety/receptor on the same cell. In some embodiments, this binding affinity differential allows for the signaling agent, e.g. mutated signaling agent, to have localized, on-target effects and to minimize off-target effects that underlie side effects that are observed with wild type signaling agent. In some embodiments, this binding affinity is at least about 2-fold, or at least about 5-fold, or at least about 10-fold, or at least about 15-fold lower, or at least about 25-fold, or at least about 50-fold lower, or at least about 100-fold, or at least about 150-fold.

Receptor binding activity may be measured using methods known in the art. For example, affinity and/or binding activity may be assessed by Scatchard plot analysis and computer-fitting of binding data (e.g. Scatchard, 1949) or by reflectometric interference spectroscopy under flow through conditions, as described by Brecht et al. (1993), the entire contents of all of which are hereby incorporated by reference.

In various embodiments, the signaling agent is an immune-modulating agent, e.g. one or more of an interleukin, interferon, and tumor necrosis factor.

In some embodiments, the signaling agent is an interleukin or a modified interleukin, including for example IL-1; IL-2; IL-3; IL-4; IL-5; IL-6; IL-7; IL-8; IL-9; IL-10; IL-11; IL-12; IL-13; IL-14; IL-15; IL-16; IL-17; IL-18; IL-19; IL-20; IL-21; IL-22; IL-23; IL-24; IL-25; IL-26; IL-27; IL-28; IL-29; IL-30; IL-31; IL-32; IL-33; IL-35; IL-36 or a fragment, variant, analogue, or family-member thereof. Interleukins are a group of multi-functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Orencole & Dinarello (1989) Cytokine 1, 14-20.

In some embodiments, the signaling agent is an interferon or a modified version of an interferon such as interferon types I, II, and III. Illustrative interferons, including for example, interferon-α-1, 2, 4, 5, 6, 7, 8, 10, 13, 14, 16, 17, and 21, interferon-β and interferon-γ, interferon κ, interferon ε, interferon τ, and interferon ω.

In some embodiments, the signaling agent is a tumor necrosis factor (TNF) or a modified version of a tumor necrosis factor (TNF) or a protein in the TNF family, including but not limited to, TNF-α, TNF-β, LT-β, CD40L, CD27L, CD30L, FASL, 4-1BBL, OX40L, and TRAIL.

The amino acid sequences of the wild type signaling agents described herein are well known in the art. Accordingly, in various embodiments the modified signaling agent comprises an amino acid sequence that has at least about 60%, or at least about 61%, or at least about 62%, or at least about 63%, or at least about 64%, or at least about 65%, or at least about 66%, or at least about 67%, or at least about 68%, or at least about 69%, or at least about 70%, or at least about 71%, or at least about 72%, or at least about 73%, or at least about 74%, or at least about 75%, or at least about 76%, or at least about 77%, or at least about 78%, or at least about 79%, or at least about 80%, or at least about 81%, or at least about 82%, or at least about 83%, or at least about 84%, or at least about 85%, or at least about 86%, or at least about 87%, or at least about 88%, or at least about 89%, or at least about 90%, or at least about 91%, or at least about 92%, or at least about 93%, or at least about 94%, or at least about 95%, or at least about 96%, or at least about 97%, or at least about 98%, or at least about 99% sequence identity with the known wild type amino acid sequences of the signaling agents described herein (e.g. about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99% sequence identity).

In various embodiments the modified signaling agent comprises an amino acid sequence that has at least about 60%, or at least about 61%, or at least about 62%, or at least about 63%, or at least about 64%, or at least about 65%, or at least about 66%, or at least about 67%, or at least about 68%, or at least about 69%, or at least about 70%, or at least about 71%, or at least about 72%, or at least about 73%, or at least about 74%, or at least about 75%, or at least about 76%, or at least about 77%, or at least about 78%, or at least about 79%, or at least about 80%, or at least about 81%, or at least about 82%, or at least about 83%, or at least about 84%, or at least about 85%, or at least about 86%, or at least about 87%, or at least about 88%, or at least about 89%, or at least about 90%, or at least about 91%, or at least about 92%, or at least about 93%, or at least about 94%, or at least about 95%, or at least about 96%, or at least about 97%, or at least about 98%, or at least about 99% sequence identity with any amino acid sequences of the signaling agents described herein (e.g. about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99% sequence identity).

In various embodiments, the modified signaling agent comprises an amino acid sequence having one or more amino acid mutations. In some embodiments, the one or more amino acid mutations may be independently selected from substitutions, insertions, deletions, and truncations. In some embodiments, the amino acid mutations are amino acid substitutions, and may include conservative and/or non-conservative substitutions, as described elsewhere herein. In various embodiments, the substitutions may also include non-classical amino acids as described elsewhere herein.

As described herein, the modified signaling agents bear mutations that affect affinity and/or activity at one or more receptors. In various embodiments, there is reduced affinity and/or activity at a therapeutic receptor, e.g. a receptor through which a desired therapeutic effect is mediated (e.g. agonism or antagonism). In various embodiments, the modified signaling agents bear mutations that substantially reduce or ablate affinity and/or activity at a receptor, e.g. a receptor through which a desired therapeutic effect is not mediated (e.g. as the result of promiscuity of binding). The receptors of any modified signaling agents, e.g. one of the cytokines, growth factors, and hormones as described herein, are known in the art.

Illustrative mutations which provide reduced affinity and/or activity (e.g. agonistic) at a receptor are found in WO 2013/107791 and PCT/EP2017/061544 (e.g. with regard to interferons), WO 2015/007542 (e.g. with regard to interleukins), and WO 2015/007903 (e.g. with regard to TNF), the entire contents of each of which are hereby incorporated by reference. Illustrative mutations which provide reduced affinity and/or activity (e.g. antagonistic) at a therapeutic receptor are found in WO 2015/007520, the entire contents of which are hereby incorporated by reference.

In some embodiments, the modified signaling agent comprises one or more mutations that cause the signaling agent to have reduced affinity and/or activity for a type I cytokine receptor, a type II cytokine receptor, a chemokine receptor, a receptor in the Tumor Necrosis Factor Receptor (TNFR) superfamily, TGF-beta Receptors, a receptor in the immunoglobulin (Ig) superfamily, and/or a receptor in the tyrosine kinase superfamily.

In various embodiments, the receptor for the signaling agent is a Type I cytokine receptor. Type I cytokine receptors are known in the art and include, but are not limited to receptors for IL2 (beta-subunit), IL3, IL4, IL5, IL6, IL7, IL9, IL11, IL12, GM-CSF, G-CSF, LIF, CNTF, and also the receptors for Thrombopoietin (TPO), Prolactin, and Growth hormone. Illustrative type I cytokine receptors include, but are not limited to, GM-CSF receptor, G-CSF receptor, LIF receptor, CNTF receptor, TPO receptor, and type I IL receptors.

In various embodiments, the receptor for the signaling agent is a Type II cytokine receptor. Type II cytokine receptors are multimeric receptors composed of heterologous subunits, and are receptors mainly for interferons. This family of receptors includes, but is not limited to, receptors for interferon-α, interferon-β and interferon-γ, IL10, IL22, and tissue factor. Illustrative type II cytokine receptors include, but are not limited to, IFN-α receptor (e.g. IFNAR1 and IFNAR2), IFN-β receptor, IFN-γ receptor (e.g. IFNGR1 and IFNGR2), and type II IL receptors.

In various embodiments, the receptor for the signaling agent is a G protein-coupled receptor. Chemokine receptors are G protein-coupled receptors with seven transmembrane structure and coupled to G-protein for signal transduction. Chemokine receptors include, but are not limited to, CC chemokine receptors, CXC chemokine receptors, CX3C chemokine receptors, and XC chemokine receptor (XCR1). Exemplary chemokine receptors include, but are not limited to, CCR1, CCR2, CCR3, CCR4, CCR5, CCR6, CCR7, CCR8, CCR9, CCR10, CXCR1, CXCR2, CXCR3, CXCR3B, CXCR4, CXCR5, CSCR6, CXCR7, XCR1, and CX3CR1.

In various embodiments, the receptor for the signaling agent is a TNFR family member. Tumor necrosis factor receptor (TNFR) family members share a cysteine-rich domain (CRD) formed of three disulfide bonds surrounding a core motif of CXXCXXC creating an elongated molecule. Exemplary tumor necrosis factor receptor family members include: CDI 20a (TNFRSFIA), CD 120b (TNFRSFIB), Lymphotoxin beta receptor (LTBR, TNFRSF3), CD 134 (TNFRSF4), CD40 (CD40, TNFRSF5), FAS (FAS, TNFRSF6), TNFRSF6B (TNFRSF6B), CD27 (CD27, TNFRSF7), CD30 (TNFRSF8), CD137 (TNFRSF9), TNFRSFIOA (TNFRSFIOA), TNFRSFIOB, (TNFRSFIOB), TNFRSFIOC (TNFRSFIOC), TNFRSFIOD (TNFRSFIOD), RANK (TNFRSFI IA), Osteoprotegerin (TNFRSFI IB), TNFRSF12A (TNFRSF12A), TNFRSF13B (TNFRSF13B), TNFRSF13C (TNFRSF13C), TNFRSF14 (TNFRSF14), Nerve growth factor receptor (NGFR, TNFRSF16), TNFRSF17 (TNFRSF17), TNFRSF18 (TNFRSF18), TNFRSF19 (TNFRSF19), TNFRSF21 (TNFRSF21), and TNFRSF25 (TNFRSF25). In an embodiment, the TNFR family member is CD120a (TNFRSF1A) or TNF-R1. In another embodiment, the TNFR family member is CD 120b (TNFRSFIB) or TNF-R2.

In various embodiments, the receptor for the signaling agent is a TGF-beta receptor. TGF-beta receptors are single pass serine/threonine kinase receptors. TGF-beta receptors include, but are not limited to, TGFBR1, TGFBR2, and TGFBR3.

In various embodiments, the receptor for the signaling agent is an Ig superfamily receptor. Receptors in the immunoglobulin (Ig) superfamily share structural homology with immunoglobulins. Receptors in the Ig superfamily include, but are not limited to, interleukin-1 receptors, CSF-1R, PDGFR (e.g. PDGFRA and PDGFRB), and SCFR.

In various embodiments, the receptor for the signaling agent is a tyrosine kinase superfamily receptor. Receptors in the tyrosine kinase superfamily are well known in the art. There are about 58 known receptor tyrosine kinases (RTKs), grouped into 20 subfamilies. Receptors in the tyrosine kinase superfamily include, but are not limited to, FGF receptors and their various isoforms such as FGFR1, FGFR2, FGFR3, FGFR4, and FGFR5.

In an embodiment, the modified signaling agent is interferon α. In such embodiments, the modified IFN-α agent has reduced affinity and/or activity for the IFN-α/β receptor (IFNAR), i.e., IFNAR1 and/or IFNAR2 chains. In some embodiments, the modified IFN-α agent has substantially reduced or ablated affinity and/or activity for the IFN-α/β receptor (IFNAR), i.e., IFNAR1 and/or IFNAR2 chains.

Mutant forms of interferon α are known to the person skilled in the art. In an illustrative embodiment, the modified signaling agent is the allelic form IFN-α2a having the amino acid sequence of SEQ ID NO: 337.

In an illustrative embodiment, the modified signaling agent is the allelic form IFN-α2b having the amino acid sequence of (which differs from IFN-α2a at amino acid position 23) SEQ ID NO: 338.

In some embodiments, said IFN-α2 mutant (IFN-α2a or IFN-α2b) is mutated atone or more amino acids at positions 144-154, such as amino acid positions 148, 149 and/or 153. In some embodiments, the IFN-α2 mutant comprises one or more mutations selected from L153A, R149A, and M148A. Such mutants are described, for example, in WO2013/107791 and Piehler et al., (2000) J. Biol. Chem, 275:40425-33, the entire contents of all of which are hereby incorporated by reference.

In some embodiments, the IFN-α2 mutants have reduced affinity and/or activity for IFNAR1. In some embodiments, the IFN-α2 mutant comprises one or more mutations selected from F64A, N65A, T69A, L80A, Y85A, and Y89A, as described in WO2010/030671, the entire contents of which is hereby incorporated by reference.

In some embodiments, the IFN-α2 mutant comprises one or more mutations selected from K133A, R144A, R149A, and L153A as described in WO2008/124086, the entire contents of which is hereby incorporated by reference.

In some embodiments, the IFN-α2 mutant comprises one or more mutations selected from R120E and R120E/K121E, as described in WO2015/007520 and WO2010/030671, the entire contents of which are hereby incorporated by reference. In such embodiments, said IFN-α2 mutant antagonizes wild type IFN-α2 activity. In such embodiments, said mutant IFN-α2 has reduced affinity and/or activity for IFNAR1 while affinity and/or activity of IFNR2 is retained.

In some embodiments, the human IFN-α2 mutant comprises (1) one or more mutations selected from R120E and R120E/K121E, which, without wishing to be bound by theory, create an antagonistic effect and (2) one or more mutations selected from K133A, R144A, R149A, and L153A, which, without wishing to be bound by theory, allow for an attenuated effect at, for example, IFNAR2. In an embodiment, the human IFN-α2 mutant comprises R120E and L153A.

In some embodiments, the human IFN-α2 mutant comprises one or more mutations selected from, L15A, A19W, R22A, R23A, L26A, F27A, L30A, L30V, K31A, D32A, R33K, R33A, R33Q, H34A, D35A, Q40A, D114R, L117A, R120A, R125A, K134A, R144A, A145G, A145M, M148A, R149A, S152A, L153A, and N156A as disclosed in WO 2013/059885, the entire disclosures of which are hereby incorporated by reference. In some embodiments, the human IFN-α2 mutant comprises the mutations H57Y, E58N, Q61S, and/or L30A as disclosed in WO 2013/059885. In some embodiments, the human IFN-α2 mutant comprises the mutations H57Y, E58N, Q61S, and/or R33A as disclosed in WO 2013/059885. In some embodiments, the human IFN-α2 mutant comprises the mutations H57Y, E58N, Q61S, and/or M148A as disclosed in WO 2013/059885. In some embodiments, the human IFN-α2 mutant comprises the mutations H57Y, E58N, Q61S, and/or L153A as disclosed in WO 2013/059885. In some embodiments, the human IFN-α2 mutant comprises the mutations N65A, L80A, Y85A, and/or Y89A as disclosed in WO 2013/059885. In some embodiments, the human IFN-α2 mutant comprises the mutations N65A, L80A, Y85A, Y89A, and/or D114A as disclosed in WO 2013/059885.

In an embodiment, the modified signaling agent is interferon β. In such embodiments, the modified interferon β agent has reduced affinity and/or activity for the IFN-α/β receptor (IFNAR), i.e., IFNAR1 and/or IFNAR2 chains. In some embodiments, the modified interferon β agent has substantially reduced or ablated affinity and/or activity for the IFN-α/β receptor (IFNAR), i.e., IFNAR1 and/or IFNAR2 chains.

In an illustrative embodiment, the modified signaling agent is IFN-β. In various embodiments, the IFN-β encompasses functional derivatives, analogs, precursors, isoforms, splice variants, or fragments of IFN-β. In various embodiments, the IFN-β encompasses IFN-β derived from any species. In an embodiment, the chimeric protein comprises a modified version of mouse IFN-β. In another embodiment, the chimeric protein comprises a modified version of human IFN-β. Human IFN-β is a polypeptide with a molecular weight of about 22 kDa comprising 166 amino acid residues. The amino acid sequence of human IFN-β is SEQ ID NO: 339.

In some embodiments, the human IFN-β is IFN-β-1a which is a glycosylated form of human IFN-β. In some embodiments, the human IFN-β is IFN-β-1b which is a non-glycosylated form of human IFN-β that has a Met-1 deletion and a Cys-17 to Ser mutation.

In various embodiments, the modified IFN-β has one or more mutations that reduce its binding to or its affinity for the IFNAR1 subunit of IFNAR. In one embodiment, the modified IFN-β has reduced affinity and/or activity at IFNAR1. In various embodiments, the modified IFN-β is human IFN-β and has one or more mutations at positions F67, R71, L88, Y92, 195, N96, K123, and R124. In some embodiments, the one or more mutations are substitutions selected from F67G, F67S, R71A, L88G, L88S, Y92G, Y92S, 195A, N96G, K123G, and R124G. In an embodiment, the modified IFN-β comprises the F67G mutation. In an embodiment, the modified IFN-β comprises the K123G mutation. In an embodiment, the modified IFN-β comprises the F67G and R71A mutations. In an embodiment, the modified IFN-β comprises the L88G and Y92G mutations. In an embodiment, the modified IFN-β comprises the Y92G, 195A, and N96G mutations. In an embodiment, the modified IFN-β comprises the K123G and R124G mutations. In an embodiment, the modified IFN-β comprises the F67G, L88G, and Y92G mutations. In an embodiment, the modified IFN-β comprises the F67S, L88S, and Y92S mutations.

In some embodiments, the modified IFN-β has one or more mutations that reduce its binding to or its affinity for the IFNAR2 subunit of IFNAR. In one embodiment, the modified IFN-β has reduced affinity and/or activity at IFNAR2. In various embodiments, the modified IFN-β is human IFN-β and has one or more mutations at positions W22, R27, L32, R35, V148, L151, R152, and Y155. In some embodiments, the one or more mutations are substitutions selected from W22G, R27G, L32A, L32G, R35A, R35G, V148G, L151G, R152A, R152G, and Y155G.

In an embodiment, the modified IFN-β comprises the W22G mutation. In an embodiment, the modified IFN-β comprises the L32A mutation. In an embodiment, the modified IFN-β comprises the L32G mutation. In an embodiment, the modified IFN-β comprises the R35A mutation. In an embodiment, the modified IFN-β comprises the R35G mutation. In an embodiment, the modified IFN-β comprises the V148G mutation. In an embodiment, the modified IFN-β comprises the R152A mutation. In an embodiment, the modified IFN-β comprises the R152G mutation. In an embodiment, the modified IFN-β comprises the Y155G mutation. In an embodiment, the modified IFN-β comprises the W22G and R27G mutations. In an embodiment, the modified IFN-β comprises the L32A and R35A mutation. In an embodiment, the modified IFN-β comprises the L151G and R152A mutations. In an embodiment, the modified IFN-β comprises the V148G and R152A mutations.

In some embodiments, the modified IFN-β has one or more of the following mutations: R35A, R35T, E42K, M62I, G78S, A141Y, A142T, E149K, and R152H. In some embodiments, the modified IFN-β has one or more of the following mutations: R35A, R35T, E42K, M62I, G78S, A141Y, A142T, E149K, and R152H combination with C17S or C17A.

In some embodiments, the modified IFN-β has one or more of the following mutations: R35A, R35T, E42K, M62I, G78S, A141Y, A142T, E149K, and R152H in combination with any of the other IFN-β mutations described herein.

The crystal structure of human IFN-β is known and is described in Karpusas et al., (1998) PNAS, 94(22): 11813-11818. Specifically, the structure of human IFN-β has been shown to include five α-helices (i.e., A, B, C, D, and E) and four loop regions that connect these helices (i.e., AB, BC, CD, and DE loops). In various embodiments, the modified IFN-β has one or more mutations in the A, B, C, D, E helices and/or the AB, BC, CD, and DE loops which reduce its binding affinity or activity at a therapeutic receptor such as IFNAR. Exemplary mutations are described in WO2000/023114 and US20150011732, the entire contents of which are hereby incorporated by reference. In an exemplary embodiment, the modified IFN-β is human IFN-β comprising alanine substitutions at amino acid positions 15, 16, 18, 19, 22, and/or 23. In an exemplary embodiment, the modified IFN-β is human IFN-β comprising alanine substitutions at amino acid positions 28-30, 32, and 33. In an exemplary embodiment, the modified IFN-β is human IFN-β comprising alanine substitutions at amino acid positions 36, 37, 39, and 42. In an exemplary embodiment, the modified IFN-β is human IFN-β comprising alanine substitutions at amino acid positions 64 and 67 and a serine substitution at position 68. In an exemplary embodiment, the modified IFN-β is human IFN-β comprising alanine substitutions at amino acid positions 71-73. In an exemplary embodiment, the modified IFN-β is human IFN-β comprising alanine substitutions at amino acid positions 92, 96, 99, and 100. In an exemplary embodiment, the modified IFN-β is human IFN-β comprising alanine substitutions at amino acid positions 128, 130, 131, and 134. In an exemplary embodiment, the modified IFN-β is human IFN-β comprising alanine substitutions at amino acid positions 149, 153, 156, and 159. In some embodiments, the mutant IFNs comprises 339 and a mutation at W22, the mutation being an aliphatic hydrophobic residue selected from glycine (G), alanine (A), leucine (L), isoleucine (I), methionine (M), and valine (V).

In some embodiments, the mutant IFNs comprises SEQ ID NO: 339 and a mutation at R27, the mutation being an aliphatic hydrophobic residue selected from glycine (G), alanine (A), leucine (L), isoleucine (I), methionine (M), and valine (V).

In some embodiments, the mutant IFNs comprises SEQ ID NO: 339 and a mutation at W22, the mutation being an aliphatic hydrophobic residue selected from glycine (G), alanine (A), leucine (L), isoleucine (I), methionine (M), and valine (V) and a mutation at R27, the mutation being an aliphatic hydrophobic residue selected from glycine (G), alanine (A), leucine (L), isoleucine (I), methionine (M), and valine (V).

In some embodiments, the mutant IFNs comprises SEQ ID NO: 339 and a mutation at L32, the mutation being an aliphatic hydrophobic residue selected from glycine (G), alanine (A), isoleucine (I), methionine (M), and valine (V).

In some embodiments, the mutant IFNs comprises SEQ ID NO: 339 and a mutation at R35, the mutation being an aliphatic hydrophobic residue selected from glycine (G), alanine (A), leucine (L), isoleucine (I), methionine (M), and valine (V).

In some embodiments, the mutant IFNs comprises SEQ ID NO: 339 and a mutation at L32, the mutation being an aliphatic hydrophobic residue selected from glycine (G), alanine (A), isoleucine (I), methionine (M), and valine (V) and a mutation at R35, the mutation being an aliphatic hydrophobic residue selected from glycine (G), alanine (A), leucine (L), isoleucine (I), methionine (M), and valine (V).

In some embodiments, the mutant IFNs comprises SEQ ID NO: 339 and a mutation at F67, the mutation being an aliphatic hydrophobic residue selected from glycine (G), alanine (A), leucine (L), isoleucine (I), methionine (M), and valine (V).

In some embodiments, the mutant IFNs comprises SEQ ID NO: 339 and a mutation at R71, the mutation being an aliphatic hydrophobic residue selected from glycine (G), alanine (A), leucine (L), isoleucine (I), methionine (M), and valine (V).

In some embodiments, the mutant IFNs comprises SEQ ID NO: 339 and a mutation at F67, the mutation being an aliphatic hydrophobic residue selected from glycine (G), alanine (A), leucine (L), isoleucine (I), methionine (M), and valine (V) and a mutation at R71, the mutation being an aliphatic hydrophobic residue selected from glycine (G), alanine (A), leucine (L), isoleucine (I), methionine (M), and valine (V).

In some embodiments, the mutant IFNs comprises SEQ ID NO: 339 and a mutation at L88, the mutation being an aliphatic hydrophobic residue selected from glycine (G), alanine (A), isoleucine (I), methionine (M), and valine (V).

In some embodiments, the mutant IFNs comprises SEQ ID NO: 339 and a mutation at Y92, the mutation being an aliphatic hydrophobic residue selected from glycine (G), alanine (A), leucine (L), isoleucine (I), methionine (M), and valine (V).

In some embodiments, the mutant IFNs comprises SEQ ID NO: 339 and a mutation at F67, the mutation being an aliphatic hydrophobic residue selected from glycine (G), alanine (A), leucine (L), isoleucine (I), methionine (M), and valine (V) and a mutation at L88, the mutation being an aliphatic hydrophobic residue selected from glycine (G), alanine (A), isoleucine (I), methionine (M), and valine (V) and a mutation at Y92, the mutation being an aliphatic hydrophobic residue selected from glycine (G), alanine (A), leucine (L), isoleucine (I), methionine (M), and valine (V).

In some embodiments, the mutant IFNs comprises SEQ ID NO: 339 and a mutation at L88, the mutation being an aliphatic hydrophobic residue selected from glycine (G), alanine (A), isoleucine (I), methionine (M), and valine (V) and a mutation at Y92, the mutation being an aliphatic hydrophobic residue selected from glycine (G), alanine (A), leucine (L), isoleucine (I), methionine (M), and valine (V).

In some embodiments, the mutant IFNs comprises SEQ ID NO: 339 and a mutation at I95, the mutation being an aliphatic hydrophobic residue selected from glycine (G), alanine (A), leucine (L), methionine (M), and valine (V) and a mutation at Y92, the mutation being an aliphatic hydrophobic residue selected from glycine (G), alanine (A), leucine (L), isoleucine (I), methionine (M), and valine (V).

In some embodiments, the mutant IFNs comprises SEQ ID NO: 339 and a mutation at N96, the mutation being an aliphatic hydrophobic residue selected from glycine (G), alanine (A), leucine (L), isoleucine (I), methionine (M), and valine (V) and a mutation at Y92, the mutation being an aliphatic hydrophobic residue selected from glycine (G), alanine (A), leucine (L), isoleucine (I), methionine (M), and valine (V).

In some embodiments, the mutant IFNs comprises SEQ ID NO: 339 and a mutation at Y92, the mutation being an aliphatic hydrophobic residue selected from glycine (G), alanine (A), leucine (L), isoleucine (I), methionine (M), and valine (V) and a mutation at I95, the mutation being an aliphatic hydrophobic residue selected from glycine (G), alanine (A), leucine (L), methionine (M), and valine (V) and a mutation at N96, the mutation being an aliphatic hydrophobic residue selected from glycine (G), alanine (A), leucine (L), isoleucine (I), methionine (M), and valine (V).

In some embodiments, the mutant IFNs comprises SEQ ID NO: 339 and a mutation at K123, the mutation being an aliphatic hydrophobic residue selected from glycine (G), alanine (A), leucine (L), isoleucine (I), methionine (M), and valine (V).

In some embodiments, the mutant IFNs comprises SEQ ID NO: 339 and a mutation at R124, the mutation being an aliphatic hydrophobic residue selected from glycine (G), alanine (A), leucine (L), isoleucine (I), methionine (M), and valine (V).

In some embodiments, the mutant IFNs comprises SEQ ID NO: 339 and a mutation at K123, the mutation being an aliphatic hydrophobic residue selected from glycine (G), alanine (A), leucine (L), isoleucine (I), methionine (M), and valine (V) and a mutation at R124, the mutation being an aliphatic hydrophobic residue selected from glycine (G), alanine (A), leucine (L), isoleucine (I), methionine (M), and valine (V).

In some embodiments, the mutant IFNs comprises SEQ ID NO: 339 and a mutation at L151, the mutation being an aliphatic hydrophobic residue selected from glycine (G), alanine (A), isoleucine (I), methionine (M), and valine (V).

In some embodiments, the mutant IFNs comprises SEQ ID NO: 339 and a mutation at R152, the mutation being an aliphatic hydrophobic residue selected from glycine (G), alanine (A), leucine (L), isoleucine (I), methionine (M), and valine (V).

In some embodiments, the mutant IFNs comprises SEQ ID NO: 339 and a mutation at L151, the mutation being an aliphatic hydrophobic residue selected from glycine (G), alanine (A), isoleucine (I), methionine (M), and valine (V) and a mutation at R152, the mutation being an aliphatic hydrophobic residue selected from glycine (G), alanine (A), leucine (L), isoleucine (I), methionine (M), and valine (V).

In some embodiments, the mutant IFNs comprises SEQ ID NO: 339 and a mutation at V148, the mutation being an aliphatic hydrophobic residue selected from glycine (G), alanine (A), leucine (L), isoleucine (I), and methionine (M).

In some embodiments, the mutant IFNs comprises SEQ ID NO: 339 and a mutation at V148, the mutation being an aliphatic hydrophobic residue selected from glycine (G), alanine (A), leucine (L), isoleucine (I), methionine (M), and valine (V) and a mutation at R152, the mutation being an aliphatic hydrophobic residue selected from glycine (G), alanine (A), leucine (L), isoleucine (I), methionine (M), and valine (V).

In some embodiments, the mutant IFNs comprises SEQ ID NO: 339 and a mutation at Y155, the mutation being an aliphatic hydrophobic residue selected from glycine (G), alanine (A), leucine (L), isoleucine (I), methionine (M), and valine (V).

In some embodiments, the present invention relates to a chimeric protein comprising: (a) a modified IFN-β, having the amino acid sequence of SEQ ID NO: 339 and a mutation at position W22, wherein the mutation is an aliphatic hydrophobic residue; and (b) one or more targeting moieties, said targeting moieties comprising recognition domains which specifically bind to antigens or receptors of interest (e.g., Clec9A), the modified IFN-β and the one or more targeting moieties are optionally connected with one or more linkers. In various embodiments the mutation at position W22 is aliphatic hydrophobic residue is selected from G, A, L, I, M, and V. In various embodiments the mutation at position W22 is G.

Additional exemplary IFNs mutants are provided in PCT/EP2017/061544, the entire disclosure of which is incorporated by reference herein.

In an embodiment, the modified signaling agent is interferon γ. In such embodiments, the modified interferon γ agent has reduced affinity and/or activity for the interferon-gamma receptor (IFNGR), i.e., IFNGR1 and IFNGR2 chains. In some embodiments, the modified interferon γ agent has substantially reduced or ablated affinity and/or activity for the interferon-gamma receptor (IFNGR), i.e., IFNGR1 and/or IFNGR2 chains.

IFN-γ is the only member of the type II class of interferons. IFN-γ is produced predominantly by natural killer (NK) and natural killer T (NKT) cells as part of the innate immune response. IFN-γ is also produced by CD4 Th1 and CD8 cytotoxic T lymphocyte (CTL) effector T cells, macrophages, dendritic cells, and B cells. Activated IFN-γ forms a dimer which acts through a heterodimeric receptor (i.e., IFN-γ receptor or IFN-γR) composed of IFN-γ receptor 1 and IFN-γ receptor 2 subunits. IFN-γ receptor 1 is the major ligand-binding subunit, while IFN-γ receptor 2 is necessary for signal transduction and also increases the affinity of IFN-γ receptor 1 for its ligand. Binding of the IFN-γ dimer to the receptor activates the JAK-STAT signaling pathway to elicit various biological effects.

In various embodiments, the modified signaling agent comprises a modified version of IFN-γ as a signaling agent. In various embodiments, the IFN-γ encompasses functional derivatives, analogs, precursors, isoforms, splice variants, or fragments of IFN-γ. In various embodiments, the IFN-γ encompasses IFN-γ derived from any species. In an embodiment, the modified signaling agent comprises a modified version of mouse IFN-γ. In another embodiment, the modified signaling agent comprises a modified version of human IFN-γ.

Human IFN-γ is a polypeptide comprising 166 amino acid residues. In an embodiment, the human IFN-γ has the amino acid sequence of SEQ ID NO: 340, in which the signal peptide comprises the first 23 amino acids.

As used herein, human IFN-γ may also refer to mature human IFN-γ without the N-terminal signal peptide. In this embodiment, the mature human IFN-γ comprises 143 amino acids and has the amino acid sequence of SEQ ID NO: 341.

In some embodiments, the human IFN-γ is a glycosylated form of human IFN-γ. In some embodiments, the human IFN-γ is a non-glycosylated form of human IFN-γ.

The sequences of IFN-γ are known in the art. In various embodiments the modified IFN-γ comprises an amino acid sequence that has at least about 60%, or at least about 61%, or at least about 62%, or at least about 63%, or at least about 64%, or at least about 65%, or at least about 66%, or at least about 67%, or at least about 68%, or at least about 69%, or at least about 70%, or at least about 71%, or at least about 72%, or at least about 73%, or at least about 74%, or at least about 75%, or at least about 76%, or at least about 77%, or at least about 78%, or at least about 79%, or at least about 80%, or at least about 81%, or at least about 82%, or at least about 83%, or at least about 84%, or at least about 85%, or at least about 86%, or at least about 87%, or at least about 88%, or at least about 89%, or at least about 90%, or at least about 91%, or at least about 92%, or at least about 93%, or at least about 94%, or at least about 95%, or at least about 96%, or at least about 97%, or at least about 98%, or at least about 99% sequence identity with the known wild type amino acid sequences of IFN-γ (e.g., about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99% sequence identity).

In some embodiments the modified IFN-γ comprises an amino acid sequence that has at least about 60%, or at least about 61%, or at least about 62%, or at least about 63%, or at least about 64%, or at least about 65%, or at least about 66%, or at least about 67%, or at least about 68%, or at least about 69%, or at least about 70%, or at least about 71%, or at least about 72%, or at least about 73%, or at least about 74%, or at least about 75%, or at least about 76%, or at least about 77%, or at least about 78%, or at least about 79%, or at least about 80%, or at least about 81%, or at least about 82%, or at least about 83%, or at least about 84%, or at least about 85%, or at least about 86%, or at least about 87%, or at least about 88%, or at least about 89%, or at least about 90%, or at least about 91%, or at least about 92%, or at least about 93%, or at least about 94%, or at least about 95%, or at least about 96%, or at least about 97%, or at least about 98%, or at least about 99% sequence identity with human IFN-γ having an amino acid sequence of SEQ ID NO: 340 (e.g., about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99% sequence identity).

In some embodiments the modified IFN-γ comprises an amino acid sequence that has at least about 60%, or at least about 61%, or at least about 62%, or at least about 63%, or at least about 64%, or at least about 65%, or at least about 66%, or at least about 67%, or at least about 68%, or at least about 69%, or at least about 70%, or at least about 71%, or at least about 72%, or at least about 73%, or at least about 74%, or at least about 75%, or at least about 76%, or at least about 77%, or at least about 78%, or at least about 79%, or at least about 80%, or at least about 81%, or at least about 82%, or at least about 83%, or at least about 84%, or at least about 85%, or at least about 86%, or at least about 87%, or at least about 88%, or at least about 89%, or at least about 90%, or at least about 91%, or at least about 92%, or at least about 93%, or at least about 94%, or at least about 95%, or at least about 96%, or at least about 97%, or at least about 98%, or at least about 99% sequence identity with human IFN-γ having an amino acid sequence of SEQ ID NO: 341 (e.g., about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99% sequence identity).

In various embodiments, the modified IFN-γ comprises an amino acid sequence having one or more amino acid mutations. In some embodiments, the one or more amino acid mutations may be independently selected from substitutions, insertions, deletions, and truncations.

In some embodiments, the amino acid mutations are amino acid substitutions, and may include conservative and/or non-conservative substitutions.

"Conservative substitutions" may be made, for instance, on the basis of similarity in polarity, charge, size, solubility, hydrophobicity, hydrophilicity, and/or the amphipathic nature of the amino acid residues involved. The 20 naturally occurring amino acids can be grouped into the following six standard amino acid groups: (1) hydrophobic: Met, Ala, Val, Leu, Ile; (2) neutral hydrophilic: Cys, Ser, Thr; Asn, Gln; (3) acidic: Asp, Glu; (4) basic: His, Lys, Arg; (5) residues that influence chain orientation: Gly, Pro; and (6) aromatic: Trp, Tyr, Phe.

As used herein, "conservative substitutions" are defined as exchanges of an amino acid by another amino acid listed within the same group of the six standard amino acid groups shown above. For example, the exchange of Asp by Glu retains one negative charge in the so modified polypeptide. In addition, glycine and proline may be substituted for one another based on their ability to disrupt α-helices.

As used herein, "non-conservative substitutions" are defined as exchanges of an amino acid by another amino acid listed in a different group of the six standard amino acid groups (1) to (6) shown above.

In various embodiments, the substitutions may also include non-classical amino acids (e.g., selenocysteine, pyrrolysine, N-formylmethionine β-alanine, GABA and δ-Aminolevulinic acid, 4-aminobenzoic acid (PABA), D-isomers of the common amino acids, 2,4-diaminobutyric acid, α-amino isobutyric acid, 4-aminobutyric acid, Abu, 2-amino butyric acid, γ-Abu, ε-Ahx, 6-amino hexanoic acid, Aib, 2-amino isobutyric acid, 3-amino propionic acid, ornithine, norleucine, norvaline, hydroxyproline, sarcosme, citrulline, homocitrulline, cysteic acid, t-butylglycine, t-butylalanine, phenylglycine, cyclohexylalanine, β-alanine, fluoro-amino acids, designer amino acids such as p methyl amino acids, C α-methyl amino acids, N α-methyl amino acids, and amino acid analogs in general).

In various embodiments, the IFN-γ is modified to have one or more mutations. In some embodiments, the mutations allow for the modified IFN-γ to have one or more of attenuated activity such as one or more of reduced binding affinity, reduced endogenous activity, and reduced specific bioactivity relative to unmutated, e.g., the wild type form of IFN-γ. For instance, the one or more of attenuated activity such as reduced binding affinity, reduced endogenous activity, and reduced specific bioactivity relative to unmutated, e.g., the wild type form of IFN-γ may be at a therapeutic receptor such as the IFN-γ receptor. Consequentially, in various embodiments, the mutations allow for the modified soluble agent to have reduced systemic toxicity, reduced side effects, and reduced off-target effects relative to unmutated, e.g., the wild type form of IFN-γ.

In various embodiments, the IFN-γ is modified to have a mutation that reduces its binding affinity and/or activity at a therapeutic receptor such as the IFN-γ receptor comprising the IFN-γ receptor 1 and IFN-γ receptor 2 subunits.

In some embodiments, the activity provided by the wild type IFN-γ is agonism at the therapeutic receptor (e.g., activation of a cellular effect at a site of therapy). For example, the wild type IFN-γ may activate the therapeutic receptor. In such embodiments, the mutation results in the modified IFN-γ to have reduced activating activity at the therapeutic receptor.

In some embodiments, the reduced affinity and/or activity at the therapeutic receptor (e.g., IFN-γ receptor) is restorable by attachment with a targeting moiety. In other embodiments, the reduced affinity and/or activity at the therapeutic receptor is not substantially restorable by attachment with the targeting moiety. In various embodiments, the therapeutic chimeric proteins of the present invention reduce off-target effects because the IFN-γ has mutations that weaken binding affinity and/or activity at a therapeutic receptor. In various embodiments, this reduces side effects observed with, for example, the wild type IFN-γ. In various embodiments, the modified IFN-γ is substantially inactive en route to the site of therapeutic activity and has its effect substantially on specifically targeted cell types which greatly reduces undesired side effects.

In various embodiments, the modified IFN-γ has one or more mutations that cause the IFN-γ to have attenuated or reduced affinity and/or activity, e.g., binding (e.g., KD) and/or activation (measurable as, for example, KA and/or EC50) for one or more therapeutic receptors (e.g., IFN-γ receptor). In various embodiments, the reduced affinity and/or activity at the therapeutic receptor allows for attenuation of activity and/or signaling from the therapeutic receptor.

In various embodiments, the modified IFN-γ has one or more mutations that reduce its binding to or its affinity for and/or biological activity for the IFN-γ receptor 1 subunit. In one embodiment, the modified IFN-γ has reduced affinity and/or activity at the IFN-γ receptor 1 subunit. In various embodiments, the modified IFN-γ is human IFN-γ that has one or more mutations at amino acid residues involved with binding to the IFN-γ receptor 1 subunit. In some embodiments, the modified IFN-γ is human IFN-γ that has one or more mutations at amino acids located at the interface with the IFN-γ receptor 1 subunit. In various embodiments, the one or more mutations are at amino acids selected from, but not limited to Q1, V5, E9, K12, H19, S20, V22, A23, D24, N25, G26, T27, L30, K108, H111, E112, I114, Q115, A118, E119, and K125 (each with respect SEQ ID NO: 341, which is a wild type human IFN-γ and which lacks its N-terminal signal sequence). In some embodiments, the one or more mutations are substitutions selected from V5E, S20E, V22A, A23G, A23F, D24G, G26Q, H111A, H111D, I114A, Q115A, and A118G (each with respect SEQ ID NO: 341). In embodiments, the one or more mutations are substitutions selected from V22A, A23G, D24G, H111A, H111D, I114A, Q115A, and A118G.

In an embodiment, the modified IFN-γ comprises the mutations A23G and D24G. In another embodiment, the modified IFN-γ comprises the mutations I114A and A118G. In a further embodiment, the modified IFN-γ comprises the mutations V5E, S20E, A23F, and G26Q.

In various embodiments, the modified IFN-γ has one or more of the following mutations: deletion of residue A23, deletion of residue D24, an S201 substitution, an A23V substitution, a D21K substitution and a D24A substitution.

In some embodiments, the modified IFN-γ has one or more mutations that reduce its binding to or its affinity and/or biological activity for the IFN-γ receptor 2 subunit.

In some embodiments, the modified IFN-γ has one or more mutations that reduce its binding to or its affinity and/or biological activity for both IFN-γ receptor 1 and IFN-γ receptor 2 subunits.

In some embodiments, the modified IFN-γ has one or more mutations that reduce its binding to or its affinity and/or biological activity for IFN-γ receptor 1 and one or more mutations that substantially reduce or ablate binding to or its affinity and/or biological activity for IFN-γ receptor 2. In some embodiments, chimeric proteins with such modified IFN-γ can provide target-selective IFN-γ receptor 1 activity (e.g., IFN-γ receptor 1 activity is restorable via targeting through the targeting moiety).

In some embodiments, the modified IFN-γ has one or more mutations that reduce its binding to or its affinity and/or biological activity for IFN-γ receptor 1 and one or more mutations that reduce its binding to or its affinity and/or biological activity for IFN-γ receptor 1. In some embodiments, chimeric proteins with such modified IFN-γ can provide target-selective IFN-γ receptor 1 and/or IFN-γ receptor 1 activity (e.g., IFN-γ receptor 1 and IFN-γ receptor 2 activities are restorable via targeting through the targeting moiety).

In various embodiments, the modified IFN-γ is truncated at the C-terminus. In some embodiments, the modified IFN-γ is mature IFN-γ comprising the amino acid sequence of SEQ ID NO: 341 with deletions of the C-terminal terminus. In such embodiments, the mature IFN-γ may comprise a C-terminal truncation of at least about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, or about 25 amino acid residues. In an embodiment, the modified IFN-γ is mature IFN-γ comprising the amino acid sequence of SEQ ID NO: 341 with C-terminal deletions of 5 amino acids. In an embodiment, the modified IFN-γ is mature IFN-γ comprising the amino acid sequence of SEQ ID NO: 341 with C-terminal deletions of 7 amino acids. In an embodiment, the modified IFN-γ is mature IFN-γ comprising the amino acid sequence of SEQ ID NO: 341 with C-terminal deletions of 14 amino acids. In an embodiment, the modified IFN-γ is mature IFN-γ comprising the amino acid sequence of SEQ ID NO: 341 with C-terminal deletions of 15 amino acids. In an embodiment, the modified IFN-γ is mature IFN-γ comprising the amino acid sequence of SEQ ID NO: 341 with C-terminal deletions of 16 amino acids. Additional modified IFN-γ with C-terminal truncations that may be utilized in the present invention is described in Haelewyn et al., Biochem. J. (1997), 324:591-595 and Lundell et al., Protein Eng. (1991) 4:335-341, the entire contents are hereby incorporated by reference.

In various embodiments, the modified IFN-γ is a single chain IFN-γ as described, for example, in Randal et al. (2001) Structure 9:155-163 and Randal et al. (1998) Protein Sci. 7:1057-1060, the entire contents are hereby incorporated by reference. In some embodiments, the single chain IFN-γ comprises a first IFN-γ chain linked at its C-terminus to the N-terminus of a second IFN-γ chain. In various embodiments, the first and second IFN-γ chains are linked by a linker, as described elsewhere herein.

In some embodiments, the first IFN-γ chain comprises a C-terminal truncation of at least about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, or about 25 amino acid residues. In an embodiment, the first IFN-γ chain comprises a C-terminal truncation of about 24 amino acid residues. In some embodiments, the second IFN-γ chain comprises an N-terminal truncation of at least about 1, about 2, about 3, about 4, or about 5 amino acid residues. In an embodiment, the second IFN-γ chain comprises an N-terminal truncation of about 3 amino acid residues. In some embodiments, the second IFN-γ chain comprises a C-terminal truncation of at least about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, or about 25 amino acid residues. In various embodiments, the first and/or second IFN-γ chains comprise one or more amino acid mutations at Q1, V5, E9, K12, H19, S20, V22, A23, D24, N25, G26, T27, L30, K108, H111, E112, I114, Q115, A118, E119, and K125, as described elsewhere herein. In various embodiments, the first and/or second IFN-γ chains comprise one or more substitutions selected from V5E, S20E, V22A, A23G, A23F, D24G, G26Q, H111A, H111D, I114A, Q115A, and A118G. In various embodiments, the first and/or second IFN-γ chains comprise one or more substitutions selected from V22A, A23G, D24G, H11A, H111D, I114A, Q115A, and A118G. In various embodiments, the first and/or second IFN-γ chains comprise the A23G and the D24G substitution. In various embodiments, the first and/or second IFN-γ chains comprise the I114A and the A118G substitution. In another embodiment, the mutations are V5E, S20E, A23F, and G26Q.

In various embodiments, a first and/or second IFN-γ chain comprises one or more substitutions as disclosed herein and the first and/or second IFN-γ chain comprises a C-terminal truncation as disclosed herein.

In various embodiments, a first and/or second IFN-γ chain comprises one or more substitutions as disclosed herein and a C-terminal truncation as disclosed herein.

The crystal structure of human IFN-γ is known and is described in, for example, Ealick et al., (1991) Science, 252: 698-702. Specifically, the structure of human IFN-γ has been shown to include a core of six α-helices and an extended unfolded sequence in the C-terminal region. In various embodiments, the modified IFN-γ has one or more mutations in the one or more helices which reduce its binding affinity and/or biological activity at a therapeutic receptor (e.g., IFN-γ receptor).

In various embodiments, the modified IFN-γ has about 1%, or about 3%, about 5%, about 10%, about 15%, about 20%, about 25%, about 30%, about 35%, about 40%, about 45%, about 50%, about 60%, about 65%, about 70%, about 75%, about 80%, about 85%, about 90%, about 95%, or about 10%-20%, about 20%-40%, about 50%, about 40%-60%, about 60%-80%, about 80%-100% of the affinity and/or biological activity for the therapeutic receptor (e.g., IFN-γ receptor or any one of its IFN-γ receptor 1 and IFN-γ receptor 2 subunits) relative to the wild type IFN-γ. In some embodiments, the binding affinity and/or biological activity is at least about 2-fold lower, about 3-fold lower, about 4-fold lower, about 5-fold lower, about 6-fold lower, about 7-fold lower, about 8-fold lower, about 9-fold lower, at least about 10-fold lower, at least about 15-fold lower, at least about 20-fold lower, at least about 25-fold lower, at least about 30-fold lower, at least about 35-fold lower, at least about 40-fold lower, at least about 45-fold lower, at least about 50-fold lower, at least about 100-fold lower, at least about 150-fold lower, or about 10-50-fold lower, about 50-100-fold lower, about 100-150-fold lower, about 150-200-fold lower, or more than 200-fold lower relative to the wild type IFN-γ.

In various embodiments, the modified IFN-γ comprises one or more mutations that reduce the endogenous activity of the IFN-γ to about 75%, or about 70%, or about 60%, or about 50%, or about 40%, or about 30%, or about 25%, or about 20%, or about 10%, or about 5%, or about 3%, or about 1%, e.g., relative to the wild type IFN-γ.

In some embodiments, the modified IFN-γ comprises one or more mutations that cause the modified IFN-γ to have reduced affinity and/or biological activity for a receptor. In some embodiments, the modified IFN-γ's binding affinity and/or biological activity for a receptor is lower than the binding affinity and/or biological activity of the targeting moiety for its receptor. In some embodiments, this binding affinity and/or biological activity differential is between the modified IFN-γ/receptor and targeting moiety/receptor on the same cell. In some embodiments, this binding affinity and/or biological activity differential allows for the modified IFN-γ to have localized, on-target effects and to minimize off-target effects that underlie side effects that are observed with wild type IFN-γ. In some embodiments, this binding affinity and/or biological activity is at least about 2-fold, or at least about 5-fold, or at least about 10-fold, or at least about 15-fold lower, or at least about 25-fold, or at least about 50-fold lower, or at least about 100-fold, or at least about 150-fold less.

Receptor binding activity may be measured using methods known in the art. For example, affinity and/or binding activity may be assessed by Scatchard plot analysis and computer-fitting of binding data (e.g., Scatchard, 1949) or by reflectometric interference spectroscopy under flow through conditions, as described by Brecht et al. (1993), the entire contents of all of which are hereby incorporated by reference.

In some embodiments, the modified signaling agent is a consensus interferon. The consensus interferon is generated by scanning the sequences of several human non-allelic IFN-α subtypes and assigning the most frequently observed amino acid in each corresponding position. The consensus interferon differs from IFN-α2b at 20 out of 166 amino acids (88% homology), and comparison with IFN-β shows identity at over 30% of the amino acid positions. In various embodiments, the consensus interferon comprises the following amino acid sequence SEQ ID NO: 342.

In some embodiments, the consensus interferon comprises the amino acid sequence of SEQ ID NO: 343, which differs from the amino acid sequence of SEQ ID NO: 342 by one amino acid, i.e., SEQ ID NO: 343 lacks the initial methionine residue of SEQ ID NO: 342.

In various embodiments, the consensus interferon comprises a modified version of the consensus interferon, i.e., a consensus interferon variant, as a signaling agent. In various embodiments, the consensus interferon variant encompasses functional derivatives, analogs, precursors, isoforms, splice variants, or fragments of the consensus interferon.

In an embodiment, the consensus interferon variants are selected form the consensus interferon variants disclosed in U.S. Pat. Nos. 4,695,623, 4,897,471, 5,541,293, and 8,496,921, the entire contents of all of which are hereby incorporated by reference. For example, the consensus interferon variant may comprise the amino acid sequence of IFN-CON2 or IFN-CON3 as disclosed in U.S. Pat. Nos. 4,695,623, 4,897,471, and 5,541,293. In an embodiment, the consensus interferon variant comprises the amino acid sequence of IFN-CON$_2$, SEQ ID NO: 344.

In an embodiment, the consensus interferon variant comprises the amino acid sequence of IFN-CON$_3$, SEQ ID NO: 345.

In an embodiment, the consensus interferon variant comprises the amino acid sequence of any one of the variants disclosed in U.S. Pat. No. 8,496,921. For example, the consensus variant may comprise the amino acid sequence of SEQ ID NO: 346.

In another embodiment, the consensus interferon variant may comprise the amino acid sequence of SEQ ID NO: 347.

In some embodiments, the consensus interferon variant may be PEGylated, i.e., comprises a PEG moiety. In an embodiment, the consensus interferon variant may comprise a PEG moiety attached at the S156C position of SEQ ID NO: 347.

In some embodiments, the engineered interferon is a variant of human IFN-α2a, with an insertion of Asp at approximately position 41 in the sequence SEQ ID NO: 348 to yield SEQ ID NO: 349 (which resulted in a renumbering of the sequence relative to IFN-α2a sequence) and the following mutations of Arg23Lys, Leu26Pro, Glu53Gln, Thr54Ala, Pro56Ser, Asp86Glu, Ile104Thr, Gly106Glu, Thr110Glu, Lys117Asn, Arg125Lys, and Lys136Thr. All embodiments herein that describe consensus interferons apply equally to this engineered interferon.

In various embodiments, the consensus interferon variant comprises an amino acid sequence having one or more amino acid mutations. In some embodiments, the one or more amino acid mutations may be independently selected from substitutions, insertions, deletions, and truncations.

In some embodiments, the amino acid mutations are amino acid substitutions, and may include conservative and/or non-conservative substitutions.

In various embodiments, the substitutions may also include non-classical amino acids (e.g. selenocysteine, pyrrolysine, N-formylmethionine β-alanine, GABA and δ-Aminolevulinic acid, 4-aminobenzoic acid (PABA), D-isomers of the common amino acids, 2,4-diaminobutyric acid, α-amino isobutyric acid, 4-aminobutyric acid, Abu, 2-amino butyric acid, γ-Abu, ε-Ahx, 6-amino hexanoic acid, Aib, 2-amino isobutyric acid, 3-amino propionic acid, ornithine, norleucine, norvaline, hydroxyproline, sarcosme, citrulline, homocitrulline, cysteic acid, t-butylglycine, t-butylalanine, phenylglycine, cyclohexylalanine, β-alanine, fluoro-amino acids, designer amino acids such as p methyl amino acids, C α-methyl amino acids, N α-methyl amino acids, and amino acid analogs in general).

In various embodiments, the consensus interferon is modified to have one or more mutations. In some embodiments, the mutations allow for the consensus interferon variant to have one or more of attenuated activity such as one or more of reduced binding affinity, reduced endogenous activity, and reduced specific bioactivity relative to unmutated, e.g., the wild type form of the consensus interferon (e.g., the consensus interferon having an amino acid sequence of SEQ ID NO: 345 or 346). For instance, the one or more of attenuated activity such as reduced binding affinity, reduced endogenous activity, and reduced specific bioactivity relative to unmutated, e.g. the wild type form of the consensus interferon, may be at a therapeutic receptor such as IFNAR. Consequentially, in various embodiments, the mutations allow for the consensus interferon variant to have reduced systemic toxicity, reduced side effects, and reduced off-target effects relative to unmutated, e.g. the wild type form of the consensus interferon.

In various embodiments, the consensus interferon is modified to have a mutation that reduces its binding affinity or activity at a therapeutic receptor such as IFNAR. In some embodiments, the activity provided by the consensus interferon is agonism at the therapeutic receptor (e.g. activation of a cellular effect at a site of therapy). For example, the consensus interferon may activate the therapeutic receptor. In such embodiments, the mutation results in the consensus interferon variant to have reduced activating activity at the therapeutic receptor.

In some embodiments, the reduced affinity or activity at the therapeutic receptor is restorable by attachment with a targeting moiety. In other embodiments, the reduced affinity or activity at the therapeutic receptor is not substantially restorable by attachment with the targeting moiety. In various embodiments, the therapeutic Fc-based chimeric proteins of the present invention reduce off-target effects because the consensus interferon variant has mutations that weaken binding affinity or activity at a therapeutic receptor. In various embodiments, this reduces side effects observed with, for example, the wild type consensus interferon. In various embodiments, the consensus interferon variant is substantially inactive en route to the site of therapeutic activity and has its effect substantially on specifically targeted cell types which greatly reduces undesired side effects.

In various embodiments, the consensus interferon variant has one or more mutations that cause the consensus interferon variant to have attenuated or reduced affinity, e.g. binding (e.g. KD) and/or activation (measurable as, for example, KA and/or EC50) for one or more therapeutic receptors. In various embodiments, the reduced affinity at the therapeutic receptor allows for attenuation of activity and/or signaling from the therapeutic receptor.

In various embodiments, the consensus interferon variant has one or more mutations that reduce its binding to or its affinity for the IFNAR1 subunit of IFNAR. In one embodiment, the consensus interferon variant has reduced affinity and/or activity at IFNAR1. In some embodiments, the consensus interferon variant has one or more mutations that reduce its binding to or its affinity for the IFNAR2 subunit of IFNAR. In some embodiments, the consensus interferon variant has one or more mutations that reduce its binding to or its affinity for both IFNAR1 and IFNAR2 subunits.

In some embodiments, the consensus interferon variant has one or more mutations that reduce its binding to or its affinity for IFNAR1 and one or more mutations that substantially reduce or ablate binding to or its affinity for IFNAR2. In some embodiments, Fc-based chimeric proteins with such consensus interferon variant can provide target-selective IFNAR1 activity (e.g. IFNAR1 activity is restorable via targeting through the targeting moiety, e.g., SIRPα).

In some embodiments, the consensus interferon variant has one or more mutations that reduce its binding to or its affinity for IFNAR2 and one or more mutations that substantially reduce or ablate binding to or its affinity for IFNAR1. In some embodiments, Fc-based chimeric proteins with such consensus interferon variant can provide target-selective IFNAR2 activity (e.g. IFNAR2 activity is restorable via targeting through the targeting moiety, e.g., SIRPα).

In some embodiments, the consensus interferon variant has one or more mutations that reduce its binding to or its affinity for IFNAR1 and one or more mutations that reduce its binding to or its affinity for IFNAR2. In some embodiments, Fc-based chimeric proteins with such consensus interferon variant can provide target-selective IFNAR1 and/or IFNAR2 activity (e.g. IFNAR1 and/IFNAR2 activity is restorable via targeting through the targeting moiety, e.g., SIRPα).

In some embodiments, the consensus interferon is modified to have a mutation at one or more amino acids at positions 145-155, such as amino acid positions 149, 150 and/or 154, with reference to SEQ ID NO: 346. In some embodiments, the consensus interferon is modified to have a mutation at one or more amino acids at positions 145-155, such as amino acid positions 149, 150 and/or 154, with reference to SEQ ID NO: 346, the substitutions optionally being hydrophobic and selected from alanine, valine, leucine, and isoleucine. In some embodiments, the consensus interferon mutant comprises one or more mutations selected from M149A, R150A, and L154A, and, with reference to SEQ ID NO: 342.

In an embodiment, the consensus interferon is modified to have a mutation at amino acid position 121 (i.e., K121), with reference to SEQ ID NO: 342. In an embodiment, the consensus interferon comprises a K121E mutation, with reference to SEQ ID NO: 342.

In some embodiments, the modified signaling agent is vascular endothelial growth factor (VEGF). VEGF is a potent growth factor that plays major roles in physiological but also pathological angiogenesis, regulates vascular permeability and can act as a growth factor on cells expressing VEGF receptors. Additional functions include, among others, stimulation of cell migration in macrophage lineage and endothelial cells. Several members of the VEGF family of growth factors exist, as well as at least three receptors (VEGFR-1, VEGFR-2, and VEGFR-3).

Members of the VEGF family can bind and activate more than one VEGFR type. For example, VEGF-A binds VEGFR-1 and -2, while VEGF-C can bind VEGFR-2 and -3. VEGFR-1 and -2 activation regulates angiogenesis while VEGFR-3 activation is associated with lymphangiogenesis. The major pro-angiogenic signal is generated from activation of VEGFR-2. VEGFR-1 activation has been reported to be possibly associated with negative role in angiogenesis. It has also been reported that VEGFR-1 signaling is important for progression of tumors in vivo via bone marrow-derived VEGFR-1 positive cells (contributing to formation of premetastatic niche in the bone).

Several therapies based on VEGF-A directed/neutralizing therapeutic antibodies have been developed, primarily for use in treatment of various human tumors relying on angiogenesis. These are not without side effects though.

This may not be surprising considering that these operate as general, non-cell/tissue specific VEGF/VEGFR interaction inhibitors. Hence, it would be desirable to restrict VEGF (e.g. VEGF-A)/VEGFR-2 inhibition to specific target cells (e.g. tumor vasculature endothelial cells).

In some embodiments, the VEGF is VEGF-A, VEGF-B, VEFG-C, VEGF-D, or VEGF-E and isoforms thereof including the various isoforms of VEGF-A such as $VEGF_{121}$, $VEGF_{121}b$, $VEGF_{145}$, $VEGF_{16}5$, $VEGF_{16}5b$, $VEGF_{189}$, and $VEGF_{206}$. In some embodiments, the modified signaling agent has reduced affinity and/or activity for VEGFR-1 (Flt-1) and/or VEGFR-2 (KDR/Flk-1). In some embodiments, the modified signaling agent has substantially reduced or ablated affinity and/or activity for VEGFR-1 (Flt-1) and/or VEGFR-2 (KDR/Flk-1). In an embodiment, the modified signaling agent has reduced affinity and/or activity for VEGFR-2 (KDR/Flk-1) and/or substantially reduced or ablated affinity and/or activity for VEGFR-1 (Flt-1). Such an embodiment finds use, for example, in wound healing methods or treatment of ischmia-related diseases (without wishing to be bound by theory, mediated by VEGFR-2's effects on endothelial cell function and angiogenesis). In various embodiments, binding to VEGFR-1 (Flt-1), which is linked to cancers and pro-inflammatory activities, is avoided. In various embodiments, VEGFR-1 (Flt-1) acts a decoy receptor and therefore substantially reduces or ablates affinity at this receptor avoids sequestration of the therapeutic agent. In an embodiment, the modified signaling agent has substantially reduced or ablated affinity and/or activity for VEGFR-1 (Flt-1) and/or substantially reduced or ablated affinity and/or activity for VEGFR-2 (KDR/Flk-1). In some embodiments, the VEGF is VEGF-C or VEGF-D. In such embodiments, the modified signaling agent has reduced affinity and/or activity for VEGFR-3. Alternatively, the modified signaling agent has substantially reduced or ablated affinity and/or activity for VEGFR-3.

Proangiogenic therapies are also important in various diseases (e.g. ischemic heart disease, bleeding etc.), and include VEGF-based therapeutics. Activation of VEGFR-2 is proangiogenic (acting on endothelial cells). Activation of VEFGR-1 can cause stimulation of migration of inflammatory cells (including, for example, macrophages) and lead to inflammation associated hypervascular permeability. Activation of VEFGR-1 can also promote bone marrow associated tumor niche formation. Thus, VEGF based therapeutic selective for VEGFR-2 activation would be desirable in this case. In addition, cell specific targeting, e.g. to endothelial cells, would be desirable.

In some embodiments, the modified signaling agent has reduced affinity and/or activity (e.g. antagonistic) for VEGFR-2 and/or has substantially reduced or ablated affinity and/or activity for VEGFR-1. When targeted to tumor vasculature endothelial cells via a targeting moiety that binds to a tumor endothelial cell marker (e.g. PSMA and others), such construct inhibits VEGFR-2 activation specifically on such marker-positive cells, while not activating VEGFR-1 en route and on target cells (if activity ablated), thus eliminating induction of inflammatory responses, for example. This would provide a more selective and safe anti-angiogenic therapy for many tumor types as compared to VEGF-A neutralizing therapies.

In some embodiments, the modified signaling agent has reduced affinity and/or activity (e.g. agonistic) for VEGFR-2 and/or has substantially reduced or ablated affinity and/or activity for VEGFR-1. Through targeting to vascular endothelial cells, such construct, in some embodiments, promotes angiogenesis without causing VEGFR-1 associated induction of inflammatory responses. Hence, such a construct would have targeted proangiogenic effects with substantially reduced risk of side effects caused by systemic activation of VEGFR-2 as well as VEGR-1.

In an illustrative embodiment, the modified signaling agent is $VEGF_{165}$, which has the amino acid sequence VEGF 165 (wild type) (SEQ ID NO: 350).

In another illustrative embodiment, the modified signaling agent is $VEGF_{165b}$, which has the amino acid sequence VEGF 165b (wild type) (SEQ ID NO: 351).

In these embodiments, the modified signaling agent has a mutation at amino acid 183 (e.g., a substitution mutation at 183, e.g., 183K, 183R, or 183H). Without wishing to be bound by theory, it is believed that such mutations may result in reduced receptor binding affinity. See, for example, U.S. Pat. No. 9,078,860, the entire contents of which are hereby incorporated by reference.

In an embodiment, the modified signaling agent is TNF-α. TNF is a pleiotropic cytokine with many diverse functions, including regulation of cell growth, differentiation, apoptosis, tumorigenesis, viral replication, autoimmunity, immune cell functions and trafficking, inflammation, and septic shock. It binds to two distinct membrane receptors on target cells: TNFR1 (p55) and TNFR2 (p75). TNFR1 exhibits a very broad expression pattern whereas TNFR2 is expressed preferentially on certain populations of lymphocytes, Tregs, endothelial cells, certain neurons, microglia, cardiac myocytes and mesenchymal stem cells. Very distinct biological pathways are activated in response to receptor activation, although there is also some overlap. As a general rule, without wishing to be bound by theory, TNFR1 signaling is associated with induction of apoptosis (cell death) and TNFR2 signaling is associated with activation of cell survival signals (e.g. activation of NFkB pathway). Administration of TNF is systemically toxic, and this is largely due to TNFR1 engagement. However, it should be noted that activation of TNFR2 is also associated with a broad range of activities and, as with TNFR1, in the context of developing TNF based therapeutics, control over TNF targeting and activity is important.

In some embodiments, the modified signaling agent has reduced affinity and/or activity for TNFR1 and/or TNFR2.

In some embodiments, the modified signaling agent has substantially reduced or ablated affinity and/or activity for TNFR1 and/or TNFR2. TNFR1 is expressed in most tissues, and is involved in cell death signaling while, by contrast, TNFR2 is involved in cell survival signaling. Accordingly, in embodiments directed to methods of treating cancer, the modified signaling agent has reduced affinity and/or activity for TNFR1 and/or substantially reduced or ablated affinity and/or activity for TNFR2. In these embodiments, the chimeric proteins may be targeted to a cell for which apoptosis is desired, e.g. a tumor cell or a tumor vasculature endothelial cell. In embodiments directed to methods of promoting cell survival, for example, in neurogenesis for the treatment of neurodegenerative disorders, the modified signaling agent has reduced affinity and/or activity for TNFR2 and/or substantially reduced or ablated affinity and/or activity for TNFR1. Stated another way, the present chimeric proteins, in some embodiments, comprise modified TNF-α agent that allows of favoring either death or survival signals.

In some embodiments, the chimeric protein has a modified TNF having reduced affinity and/or activity for TNFR1 and/or substantially reduced or ablated affinity and/or activity for TNFR2. Such a chimera, in some embodiments, is a more potent inducer of apoptosis as compared to a wild type TNF and/or a chimera bearing only mutation(s) causing reduced affinity and/or activity for TNFR1. Such a chimera, in some embodiments, finds use in inducing tumor cell death or a tumor vasculature endothelial cell death (e.g. in the treatment of cancers). Also, in some embodiments, these chimeras avoid or reduce activation of $T_{reg}$ cells via TNFR2, for example, thus further supporting TNFR1-mediated antitumor activity in vivo.

In some embodiments, the chimeric protein has a modified TNF having reduced affinity and/or activity for TNFR2 and/or substantially reduced or ablated affinity and/or activity for TNFR1. Such a chimera, in some embodiments, is a more potent activator of cell survival in some cell types, which may be a specific therapeutic objective in various disease settings, including without limitation, stimulation of neurogenesis. In addition, such a TNFR2-favoring chimeras also are useful in the treatment of autoimmune diseases (e.g. Crohn's, diabetes, MS, colitis etc. and many others described herein). In some embodiments, the chimera is targeted to auto-reactive T cells. In some embodiments, the chimera promotes $T_{reg}$ cell activation and indirect suppression of cytotoxic T cells.

In some embodiments, the chimera causes the death of auto-reactive T cells, e.g. by activation of TNFR2 and/or avoidance of TNFR1 (e.g. a modified TNF having reduced affinity and/or activity for TNFR2 and/or substantially reduced or ablated affinity and/or activity for TNFR1). Without wishing to be bound by theory these auto-reactive T cells, have their apoptosis/survival signals altered e.g. by NFkB pathway activity/signaling alterations. In some embodiments, the chimera causes the death of autoreactive T cells having lesions or modifications in the NFkB pathway, which underlie an imbalance of their cell death (apoptosis)/survival signaling properties and, optionally, altered susceptibility to certain death-inducing signals (e.g., TNFR2 activation).

In some embodiments, a TNFR2 based chimera has additional therapeutic applications in diseases, including various autoimmune diseases, heart disease, de-myelinating and neurodegenerative disorders, and infectious disease, among others.

In an embodiment, the wild type TNF-α has the amino acid sequence of SEQ ID NO: 352.

In such embodiments, the modified TNF-α agent has mutations at one or more amino acid positions 29, 31, 32, 84, 85, 86, 87, 88, 89, 145, 146 and 147 which produces a modified TNF-α with reduced receptor binding affinity.

See, for example, U.S. Pat. No. 7,993,636, the entire contents of which are hereby incorporated by reference.

In some embodiments, the modified human TNF-α moiety has mutations at one or more amino acid positions R32, N34, Q67, H73, L75, T77, S86, Y87, V91, I97, T105, P106, A109, P113, Y115, E127, N137, D143, A145, and E146 as described, for example, in WO/2015/007903, the entire contents of which is hereby incorporated by reference (numbering according to the human TNF sequence, Genbank accession number BAG70306, version BAG70306.1 GI: 197692685). In some embodiments, the modified human TNF-α moiety has substitution mutations selected from L29S, R32G, R32W, N34G, Q67G, H73G, L75G, L75A, L75S, T77A, S86G, S86T, Y87Q, Y87L, Y87A, Y87F, Y87H, V91G, V91A, I97A, I97Q, I97S, T105G, P106G, A109Y, P113G, Y115G, Y115A, E127G, N137G, D143N, A145G, A145R, A145T, E146D, E146K, and S147D. In an embodiment, the human TNF-α moiety has a mutation selected from Y87Q, Y87L, Y87A, Y87F, and Y87H. In another embodiment, the human TNF-α moiety has a mutation selected from 197A, 197Q, and 197S. In a further embodiment, the human TNF-α moiety has a mutation selected from Y115A and Y115G. In an embodiment, the human TNF-α moiety has an E146K mutation.

In an embodiment, the human TNF-α moiety has an Y87H and an E146K mutation. In an embodiment, the human TNF-α moiety has an Y87H and an A145R mutation. In an embodiment, the human TNF-α moiety has a R32W and a S86T mutation. In an embodiment, the human TNF-α moiety has a R32W and an E146K mutation. In an embodiment, the human TNF-α moiety has a L29S and a R32W mutation. In an embodiment, the human TNF-α moiety has a D143N and an A145R mutation. In an embodiment, the human TNF-α moiety has a D143N and an A145R mutation. In an embodiment, the human TNF-α moiety has an A145T, an E146D, and a S147D mutation. In an embodiment, the human TNF-α moiety has an A145T and a S147D mutation.

In some embodiments, the modified TNF-α agent has one or more mutations selected from N39Y, S147Y, and Y87H, as described in WO2008/124086, the entire contents of which is hereby incorporated by reference.

In some embodiments, the modified human TNF-α moiety has mutations that provide receptor selectivity as described in PCT/IB2016/001668, the entire contents of which are hereby incorporated by reference. In some embodiments, the mutations to TNF are TNF-R1 selective. In some embodiments, the mutations to TNF which are TNF-R1 selective are at one or more of positions R32, S86, and E146. In some embodiments, the mutations to TNF which are TNF-R1 selective are one or more of R32W, S86T, and E146K. In some embodiments, the mutations to TNF which are TNF-R1 selective are one or more of R32W, R32W/S86T, R32W/E146K and E146K. In some embodiments, the mutations to TNF are TNF-R2 selective. In some embodiments, the mutations to TNF which are TNF-R2 selective are at one or more of positions A145, E146, and S147. In some embodiments, the mutations to TNF which are TNF-R2 selective are one or more of A145T, A145R, E146D, and S147D. In some embodiments, the mutations to TNF which are TNF-R2 selective are one or more of A145R, A145T/S147D, and A145T/E146D/S147D.

In an embodiment, the modified signaling agent is TNF-β. TNF-β can form a homotrimer or a heterotrimer with LT-β (LT-α1β2). In some embodiments, the modified signaling agent has substantially reduced or ablated affinity and/or activity for TNFR1 and/or TNFR2 and/or herpes virus entry mediator (HEVM) and/or LT-βR.

In an embodiment, the wild type TNF-β has the amino acid sequence of SEQ ID NO: 353.

In such embodiments, the modified soluble agent may comprise mutations at one or more amino acids at positions 106-113, which produce a modified TNF-β with reduced receptor binding affinity to TNFR2. In an embodiment, the modified soluble agent has one or more substitution mutations at amino acid positions 106-113. In illustrative embodiments, the substitution mutations are selected from Q107E, Q107D, S106E, S106D, Q107R, Q107N, Q107E/S106E, Q107E/S106D, Q107D/S106E, and Q107D/S106D. In another embodiment, the modified soluble agent has an insertion of about 1 to about 3 amino acids at positions 106-113.

In some embodiments, the modified agent is a TNF family member (e.g. TNF-alpha, TNF-beta) which can be a single chain trimeric version as described in WO 2015/007903, the entire contents of which are incorporated by reference.

In some embodiments, the modified agent is a TNF family member (e.g. TNF-alpha, TNF-beta) which has reduced affinity and/or activity, i.e. antagonistic activity (e.g. natural antagonistic activity or antagonistic activity that is the result of one or more mutations, see, e.g., WO 2015/007520, the entire contents of which are hereby incorporated by reference) at TNFR1. In these embodiments, the modified agent is a TNF family member (e.g. TNF-alpha, TNF-beta) which also, optionally, has substantially reduced or ablated affinity and/or activity for TNFR2. In some embodiments, the modified agent is a TNF family member (e.g. TNF-alpha, TNF-beta) which has reduced affinity and/or activity, i.e. antagonistic activity (e.g. natural antagonistic activity or antagonistic activity that is the result of one or more mutations, see, e.g., WO 2015/007520, the entire contents of which are hereby incorporated by reference) at TNFR2. In these embodiments, the modified agent is a TNF family member (e.g. TNF-alpha, TNF-beta) which also, optionally, has substantially reduced or ablated affinity and/or activity for TNFR1. The constructs of such embodiments find use in, for example, methods of dampening TNF response in a cell specific manner. In some embodiments, the antagonistic TNF family member (e.g. TNF-alpha, TNF-beta) is a single chain trimeric version as described in WO 2015/007903.

In an embodiment, the modified signaling agent is TRAIL. In some embodiments, the modified TRAIL agent has reduced affinity and/or activity for DR4 (TRAIL-RI) and/or DR5 (TRAIL-RII) and/or DcR1 and/or DcR2. In some embodiments, the modified TRAIL agent has substantially reduced or ablated affinity and/or activity for DR4 (TRAIL-RI) and/or DR5 (TRAIL-RII) and/or DcR1 and/or DcR2.

In an embodiment, the wild type TRAIL has the amino acid sequence of SEQ ID NO: 354.

In such embodiments, the modified TRAIL agent may comprise a mutation at amino acid positions T127-R132, E144-R149, E155-H161, Y189-Y209, T214-1220, K224-A226, W231, E236-L239, E249-K251, T261-H264 and H270-E271 (Numbering based on the human sequence, Genbank accession number NP 003801, version 10 NP_003801.1, GI: 4507593; see above).

In some embodiments, the modified TRAIL agent may comprise one or more mutations that substantially reduce its affinity and/or activity for TRAIL-R1. In such embodiments, the modified TRAIL agent may specifically bind to TRIL-R2. Exemplary mutations include mutations at one or more amino acid positions Y189, R191, Q193, H264, I266, and D267. For example, the mutations may be one or more of Y189Q, R191K, Q193R, H264R, I266L and D267Q. In an embodiment, the modified TRAIL agent comprises the mutations Y189Q, R191K, Q193R, H264R, I266L and D267Q.

In some embodiments, the modified TRAIL agent may comprise one or more mutations that substantially reduce its affinity and/or activity for TRAIL-R2. In such embodiments, the modified TRAIL agent may specifically bind to TRIL-R1. Exemplary mutations include mutations at one or more amino acid positions G131, R149, S159, N199, K201, and S215. For example, the mutations may be one or more of G131R, R149I, S159R, N199R, K201H, and S215D. In an embodiment, the modified TRAIL agent comprises the mutations G131R, R149I, S159R, N199R, K201H, and S215D. Additional TRAIL mutations are described in, for example, Trebing et al., (2014) Cell Death and Disease, 5:e1035, the entire disclosure of which is hereby incorporated by reference.

In an embodiment, the modified signaling agent is TGFα. In such embodiments, the modified TGFα agent has reduced affinity and/or activity for the epidermal growth factor receptor (EGFR). In some embodiments, the modified TGFα agent has substantially reduced or ablated affinity and/or activity for the epidermal growth factor receptor (EGFR).

In an embodiment, the modified signaling agent is TGFβ. In such embodiments, the modified signaling agent has reduced affinity and/or activity for TGFBR1 and/or TGFBR2. In some embodiments, the modified signaling agent has substantially reduced or ablated affinity and/or activity for TGFBR1 and/or TGFBR2. In some embodiments, the modified signaling agent optionally has reduced or substantially reduced or ablated affinity and/or activity for TGFBR3 which, without wishing to be bound by theory, may act as a reservoir of ligand for TGF-beta receptors. In some embodiments, the TGFβ may favor TGFBR1 over TGFBR2 or TGFBR2 over TGFBR1. Similarly, LAP, without wishing to be bound by theory, may act as a reservoir of ligand for TGF-beta receptors. In some embodiments, the modified signaling agent has reduced affinity and/or activity for TGFBR1 and/or TGFBR2 and/or substantially reduced or ablated affinity and/or activity for Latency Associated Peptide (LAP). In some embodiments, such chimeras find use in Camurati-Engelmann disease, or other diseases associated with inappropriate TGFβ signaling.

In some embodiments, the modified agent is a TGF family member (e.g. TGFα, TGFβ) which has reduced affinity and/or activity, i.e. antagonistic activity (e.g. natural antagonistic activity or antagonistic activity that is the result of one or more mutations, see, e.g., WO 2015/007520, the entire contents of which are hereby incorporated by reference) at one or more of TGFBR1, TGFBR2, TGFBR3. In these embodiments, the modified agent is a TGF family member (e.g. TGFα, TGFβ) which also, optionally, has substantially reduced or ablated affinity and/or activity at one or more of TGFBR1, TGFBR2, TGFBR3.

In some embodiments, the modified agent is a TGF family member (e.g. TGFα, TGFβ) which has reduced affinity and/or activity, i.e. antagonistic activity (e.g. natural antagonistic activity or antagonistic activity that is the result of one or more mutations, see, e.g., WO 2015/007520, the entire contents of which are hereby incorporated by reference) at TGFBR1 and/or TGFBR2. In these embodiments, the modified agent is a TGF family member (e.g. TGFα, TGFβ) which also, optionally, has substantially reduced or ablated affinity and/or activity at TGFBR3.

In an embodiment, the modified signaling agent is an interleukin. In an embodiment, the modified signaling agent is IL-1. In an embodiment, the modified signaling agent is IL-1α or IL-1β. In some embodiments, the modified signaling agent has reduced affinity and/or activity for IL-1R1 and/or IL-1RAcP. In some embodiments, the modified signaling agent has substantially reduced or ablated affinity and/or activity for IL-1R1 and/or IL-1RAcP. In some embodiments, the modified signaling agent has reduced affinity and/or activity for IL-1R2. In some embodiments, the modified signaling agent has substantially reduced or ablated affinity and/or activity for IL-1R2. For instance, in some embodiments, the present modified IL-1 agents avoid interaction at IL-1R2 and therefore substantially reduce its function as a decoy and/or sink for therapeutic agents.

In an embodiment, the wild type IL-1β has the amino acid sequence of IL-1 beta (mature form, wild type) (SEQ ID NO: 355).

IL1 is a proinflammatory cytokine and an important immune system regulator. It is a potent activator of CD4 T cell responses, increases proportion of Th17 cells and expansion of IFNγ and IL-4 producing cells. IL-1 is also a potent regulator of CD8$^+$ T cells, enhancing antigen-specific CD8$^+$ T cell expansion, differentiation, migration to periphery and memory. IL-1 receptors comprise IL-1R1 and IL-1R2. Binding to and signaling through the IL-1R1 constitutes the mechanism whereby IL-1 mediates many of its biological (and pathological) activities. IL1-R2 can function as a decoy receptor, thereby reducing IL-1 availability for interaction and signaling through the IL-1R1.

In some embodiments, the modified IL-1 has reduced affinity and/or activity (e.g. agonistic activity) for IL-1R1. In some embodiments, the modified IL-1 has substantially reduced or ablated affinity and/or activity for IL-1R2. In such embodiments, there is restorable IL-1/IL-1R1 signaling and prevention of loss of therapeutic chimeras at IL-R2 and therefore a reduction in dose of IL-1 that is required (e.g. relative to wild type or a chimera bearing only an attenuation mutation for IL-R1). Such constructs find use in, for example, methods of treating cancer, including, for example, stimulating the immune system to mount an anti-cancer response.

In some embodiments, the modified IL-1 has reduced affinity and/or activity (e.g. antagonistic activity, e.g. natural antagonistic activity or antagonistic activity that is the result of one or more mutations, see, e.g., WO 2015/007520, the entire contents of which are hereby incorporated by reference) for IL-1R1. In some embodiments, the modified IL-1 has substantially reduced or ablated affinity and/or activity for IL-1R2. In such embodiments, there is the IL-1/IL-1R1 signaling is not restorable and prevention of loss of therapeutic chimeras at IL-R2 and therefore a reduction in dose of IL-1 that is required (e.g. relative to wild type or a chimera bearing only an attenuation mutation for IL-R1). Such constructs find use in, for example, methods of treating autoimmune diseases, including, for example, suppressing the immune system.

In such embodiments, the modified signaling agent has a deletion of amino acids 52-54 which produces a modified human IL-1β with reduced binding affinity for type I IL-1R and reduced biological activity. See, for example, WO 1994/000491, the entire contents of which are hereby incorporated by reference. In some embodiments, the modified human IL-1β has one or more substitution mutations selected from A117G/P118G, R120X, L122A, T125G/L126G, R127G, Q130X, Q131G, K132A, S137G/Q138Y, L145G, H146X, L145A/L147A, Q148X, Q148G/Q150G, Q150G/D151A, M152G, F162A, F162A/Q164E, F166A, Q164E/E167K, N169G/D170G, I172A, V174A, K208E, K209X, K209A/K210A, K219X, E221X, E221 S/N224A, N224S/K225S, E244K, N245Q (where X can be any change in amino acid, e.g., a non-conservative change), which exhibit reduced binding to IL-1R, as described, for example, in WO2015/007542 and WO/2015/007536, the entire contents of which is hereby incorporated by reference (numbering base on the human IL-1β sequence, Genbank accession number NP_000567, version NP-000567.1, GI: 10835145). In some embodiments, the modified human IL-1β may have one or more mutations selected from R120A, R120G, Q130A, Q130W, H146A, H146G, H146E, H146N, H146R, Q148E, Q148G, Q148L, K209A, K209D, K219S, K219Q, E221S and E221K. In an embodiment, the modified human IL-1β comprises the mutations Q131G and Q148G. In an embodiment, the modified human IL-1β comprises the mutations Q148G and K208E. In an embodiment, the modified human IL-1β comprises the mutations R120G and Q131G. In an embodiment, the modified human IL-1β comprises the mutations R120G and H146A. In an embodiment, the modified human IL-1β comprises the mutations R120G and H146N. In an embodiment, the modified human IL-1β comprises the mutations R120G and H146R. In an embodiment, the modified human IL-1β comprises the mutations R120G and H146E. In an embodiment, the modified human IL-1β comprises the mutations R120G and H146G. In an embodiment, the modified human IL-1β comprises the mutations R120G and K208E. In an embodiment, the modified human IL-1β comprises the mutations R120G, F162A, and Q164E.

In an embodiment, the modified signaling agent is IL-2. In such an embodiment, the modified signaling agent has reduced affinity and/or activity for IL-2Rα and/or IL-2Rβ and/or IL-2Rγ. In some embodiments, the modified signaling agent has reduced affinity and/or activity for IL-2Rβ and/or IL-2Rγ. In some embodiments, the modified signaling agent has substantially reduced or ablated affinity and/or activity for IL-2Rα. Such embodiments may be relevant for treatment of cancer, for instance when the modified IL-2 is agonistic at IL-2Rβ and/or IL-2Rγ. For instance, the present constructs may favor attenuated activation of CD8$^+$ T cells (which can provide an anti-tumor effect), which have IL2 receptors β and γ and disfavor $T_{regs}$ (which can provide an immune suppressive, pro-tumor effect), which have IL2 receptors α, β, and γ. Further, in some embodiments, the preferences for IL-2Rβ and/or IL-2Rγ over IL-2Rα avoid IL-2 side effects such as pulmonary edema. Also, IL-2-based chimeras are useful for the treatment of autoimmune diseases, for instance when the modified IL-2 is antagonistic (e.g. natural antagonistic activity or antagonistic activity that is the result of one or more mutations, see, e.g., WO 2015/007520, the entire contents of which are hereby incorporated by reference) at IL-2Rβ and/or IL-2Rγ. For instance, the present constructs may favor attenuated suppression of CD8$^+$ T cells (and therefore dampen the immune response), which have IL2 receptors β and γ and disfavor $T_{regs}$ which have IL2 receptors α, β, and γ. Alternatively, in some embodiments, the chimeras bearing IL-2 favor the activation of $T_{regs}$, and therefore immune suppression, and activation of disfavor of CD8$^+$ T cells. For instance, these constructs find use in the treatment of diseases or diseases that would benefit from immune suppression, e.g. autoimmune disorders.

In some embodiments, the chimeric protein has targeting moieties as described herein directed to Clec9A$^+$ dendritic cells as well as a modified IL-2 agent having reduced affinity and/or activity for IL-2Rβ and/or IL-2Rγ and/or substantially reduced or ablated affinity and/or activity for IL-2Rα. In some embodiments, these constructs provide targeted Clec9A+ dendritic cell activity and are generally inactive (or have substantially reduced activity) towards $T_{reg}$ cells. In some embodiments, such constructs have enhanced immune stimulatory effect compared to wild type IL-2 (e.g., without wishing to be bound by theory, by not stimulating Tregs), whilst eliminating or reducing the systemic toxicity associated with IL-2.

In an embodiment, the wild type IL-2 has the amino acid sequence of IL-2 (mature form, wild type) (SEQ ID NO: 356).

In such embodiments, the modified IL-2 agent has one or more mutations at amino acids L72 (L72G, L72A, L72S, L72T, L72Q, L72E, L72N, L72D, L72R, or L72K), F42 (F42A, F42G, F42S, F42T, F42Q, F42E, F42N, F42D, F42R, or F42K) and Y45 (Y45A, Y45G, Y45S, Y45T, Y45Q, Y45E, Y45N, Y45D, Y45R or Y45K). Without wishing to be bound by theory, it is believed that these modified IL-2 agents have reduced affinity for the high-affinity IL-2 receptor and preserves affinity to the intermediate-affinity IL-2 receptor, as compared to the wild-type IL-2. See, for example, US Patent Publication No. 2012/0244112, the entire contents of which are hereby incorporated by reference.

In some embodiments, the modified IL-2 agent has one or more mutations at amino acids R38, F42, Y45, and E62. For example, the modified IL-2 agent may comprise one or more of R38A, F42A, Y45A, and E62A. In some embodiments, the modified IL-2 agent may comprise a mutation at C125. For example, the mutation may be C125S. In such embodiments, the modified IL-2 agent may have substantially reduced affinity and/or activity for IL-2Rα, as described in, for example, Carmenate et al. (2013) The Journal of Immunology, 190:6230-6238, the entire disclosure of which is hereby incorporated by reference. In some embodiments, the modified IL-2 agent with mutations at R38, F42, Y45, and/or E62 is able to induce an expansion of effector cells including CD8+ T cells and NK cells but not Treg cells. In some embodiments, the modified IL-2 agent with mutations at R38, F42, Y45, and/or E62 is less toxic than wildtype IL-2 agents. A chimeric protein comprising the modified IL-2 agent with substantially reduced affinity and/or activity for IL-2Rα may find application in oncology for example. In other embodiments, the modified IL-2 agent may have substantially reduced affinity and/or activity for IL-2Rβ, as described in, for example, WO2016/025385, the entire disclosure of which is hereby incorporated by reference. In such embodiments, the modified IL-2 agent may induce an expansion of Treg cells but not effector cells such as CD8+ T cells and NK cells. A chimeric protein comprising the modified IL-2 agent with substantially reduced affinity and/or activity for IL-2Rβ may find application in the treatment of autoimmune disease for example. In some embodiments, the modified IL-2 agent may comprise one or more mutations at amino acids N88, D20, and/r A126. For example, the modified IL-2 agent may comprise one or more of N88R, N88I, N88G, D20H, Q126L, and Q126F.

In various embodiments, the modified IL-2 agent may comprise a mutation at D109 or C125. For example, the mutation may be D109C or C125S. In some embodiments, the modified IL-2 with a mutation at D109 or C125 may be utilized for attachment to a PEG moiety.

In an embodiment, the modified signaling agent is IL-3. In some embodiments, the modified signaling agent has reduced affinity and/or activity for the IL-3 receptor, which is a heterodimer with a unique alpha chain paired with the common beta (beta c or CD131) subunit. In some embodiments, the modified signaling agent has substantially reduced or ablated affinity and/or activity for the IL-3 receptor, which is a heterodimer with a unique alpha chain paired with the common beta (beta c or CD131) subunit.

In an embodiment, the modified signaling agent is IL-4. In such an embodiment, the modified signaling agent has reduced affinity and/or activity for type 1 and/or type 2 IL-4 receptors. In such an embodiment, the modified signaling agent has substantially reduced or ablated affinity and/or activity for type 1 and/or type 2 IL-4 receptors. Type 1 IL-4 receptors are composed of the IL-4Rα subunit with a common γ chain and specifically bind IL-4. Type 2 IL-4 receptors include an IL-4Rα subunit bound to a different subunit known as IL-13Rα1. In some embodiments, the modified signaling agent has substantially reduced or ablated affinity and/or activity the type 2 IL-4 receptors.

In an embodiment, the wild type IL-4 has the amino acid sequence of IL-4 (mature form, wild type) (SEQ ID NO: 357).

In such embodiments, the modified IL-4 agent has one or more mutations at amino acids R121 (R121A, R121D, R121E, R121F, R121H, R121I, R121K, R121N, R121P, R121T, R121W), E122 (E122F), Y124 (Y124A, Y124Q, Y124R, Y124S, Y124T) and S125 (S125A). Without wishing to be bound by theory, it is believed that these modified IL-4 agents maintain the activity mediated by the type I receptor, but significantly reduces the biological activity mediated by the other receptors. See, for example, U.S. Pat. No. 6,433,157, the entire contents of which are hereby incorporated by reference.

In an embodiment, the modified signaling agent is IL-6. IL-6 signals through a cell-surface type I cytokine receptor complex including the ligand-binding IL-6R chain (CD126), and the signal-transducing component gp130. IL-6 may also bind to a soluble form of IL-6R (sIL-6R), which is the extracellular portion of IL-6R. The sIL-6R/IL-6 complex may be involved in neurites outgrowth and survival of neurons and, hence, may be important in nerve regeneration through remyelination. Accordingly, in some embodiments, the modified signaling agent has reduced affinity and/or activity for IL-6R/gp130 and/or sIL-6R. In some embodiments, the modified signaling agent has substantially reduced or ablated affinity and/or activity for IL-6R/gp130 and/or sIL-6R.

In an embodiment, the wild type IL-6 has the amino acid sequence of IL-6 (mature form, wild type) (SEQ ID NO: 358).

In such embodiments, the modified signaling agent has one or more mutations at amino acids 58, 160, 163, 171 or 177. Without wishing to be bound by theory, it is believed that these modified IL-6 agents exhibit reduced binding affinity to IL-6Ralpha and reduced biological activity. See, for example, WO 97/10338, the entire contents of which are hereby incorporated by reference.

In an embodiment, the modified signaling agent is IL-10. In such an embodiment, the modified signaling agent has reduced affinity and/or activity for IL-10 receptor-1 and IL-10 receptor-2. In some embodiments, the modified signaling agent has substantially reduced or ablated affinity and/or activity for IL-10 receptor-1 and IL-10 receptor-2

In an embodiment, the modified signaling agent is IL-11. In such an embodiment, the modified signaling agent has reduced affinity and/or activity for IL-11Rα and/or IL-11Rβ and/or gp130. In such an embodiment, the modified signaling agent has substantially reduced or ablated affinity and/or activity for IL-11Rα and/or IL-11Rβ and/or gp130.

In an embodiment, the modified signaling agent is IL-12. In such an embodiment, the modified signaling agent has reduced affinity and/or activity for IL-12Rβ1 and/or IL-12Rβ2. In such an embodiment, the modified signaling agent has substantially reduced or ablated affinity and/or activity for IL-12Rβ1 and/or IL-12Rβ2.

In an embodiment, the modified signaling agent is IL-13. In such an embodiment, the modified signaling agent has reduced affinity and/or activity for the IL-4 receptor (IL-4Rα) and IL-13Rα1. In some embodiments, the modified signaling agent has substantially reduced or ablated affinity and/or activity for IL-4 receptor (IL-4Rα) or IL-13Rα1.

In an embodiment, the wild type IL-13 has the amino acid sequence of IL-13 (mature form, wild type) (SEQ ID NO: 359).

In such embodiments, the modified IL-13 agent has one or more mutations at amino acids 13, 16, 17, 66, 69, 99, 102, 104, 105, 106, 107, 108, 109, 112, 113 and 114. Without wishing to be bound by theory, it is believed that these modified IL-13 agents exhibit reduced biological activity. See, for example, WO 2002/018422, the entire contents of which are hereby incorporated by reference.

In an embodiment, the modified signaling agent is IL-18. In some embodiments, the modified signaling agent has reduced affinity and/or activity for IL-18Rα and/or IL-18Rβ. In some embodiments, the modified signaling agent has substantially reduced or ablated affinity and/or activity for IL-18Rα and/or IL-18Rβ. In some embodiments, the modified signaling agent has substantially reduced or ablated affinity and/or activity for IL-18Rα type II, which is an isoform of IL-18Rα that lacks the TIR domain required for signaling.

In an embodiment, the wild type IL-18 has the amino acid sequence of IL-18 (wild type) (SEQ ID NO: 360).

In such embodiments, the modified IL-18 agent may comprise one or more mutations in amino acids or amino acid regions selected from Y37-K44, R49-Q54, D59-R63, E67-C74, R80, M87-A97, N 127-K129, Q139-M149, K165-K171, R183 and Q190-N191, as described in WO/2015/007542, the entire contents of which are hereby incorporated by reference (numbering based on the human IL-18 sequence, Genbank accession number AAV38697, version AAV38697.1, GI: 54696650).

In an embodiment, the modified signaling agent is IL-33. In such an embodiment, the modified signaling agent has reduced affinity and/or activity for the ST-2 receptor and IL-1RAcP. In some embodiments, the modified signaling agent has substantially reduced or ablated affinity and/or activity for the ST-2 receptor and IL-1RAcP.

In an embodiment, the wild type IL-33 has the amino acid sequence of SEQ ID NO: 361.

In such embodiments, the modified IL-33 agent may comprise one or more mutations in amino acids or amino acid regions selected from 1113-Y122, S127-E139, E144-D157, Y163-M183, E200, Q215, L220-C227 and T260-E269, as described in WO/2015/007542, the entire contents of which are hereby incorporated by reference (numbering based on the human sequence, Genbank accession number NP_254274, version NP_254274.1, GI:15559209).

In an embodiment, the modified signaling agent is epidermal growth factor (EGF). EGF is a member of a family of potent growth factors. Members include EGF, HB-EGF, and others such as TGFalpha, amphiregulin, neuregulins, epiregulin, betacellulin. EGF family receptors include EGFR (ErbB1), ErbB2, ErbB3 and ErbB4. These may function as homodimeric and/or heterodimeric receptor subtypes. The different EGF family members exhibit differential selectivity for the various receptor subtypes. For example, EGF associates with ErbB1/ErbB1, ErbB1/ErbB2, ErbB4/ErbB2 and some other heterodimeric subtypes. HB-EGF has a similar pattern, although it also associates with ErbB4/4. Modulation of EGF (EGF-like) growth factor signaling, positively or negatively, is of considerable therapeutic interest. For example, inhibition of EGFRs signaling is of interest in the treatment of various cancers where EGFR signaling constitutes a major growth promoting signal. Alternatively, stimulation of EGFRs signaling is of therapeutic interest in, for example, promoting wound healing (acute and chronic), oral mucositis (a major side-effect of various cancer therapies, including, without limitation radiation therapy).

In some embodiments, the modified signaling agent has reduced affinity and/or activity for ErbB1, ErbB2, ErbB3, and/or ErbB4. Such embodiments find use, for example, in methods of treating wounds. In some embodiments, the modified signaling agent binds to one or more ErbB1, ErbB2, ErbB3, and ErbB4 and antagonizes the activity of the receptor. In such embodiments, the modified signaling agent has reduced affinity and/or activity for ErbB1, ErbB2, ErbB3, and/or ErbB4 which allows for the activity of the receptor to be antagonized in an attenuated fashion. Such embodiments find use in, for example, treatments of cancer. In an embodiment, the modified signaling agent has reduced affinity and/or activity for ErbB1. ErbB1 is the therapeutic target of kinase inhibitors—most have side effects because they are not very selective (e.g., gefitinib, erlotinib, afatinib, brigatinib and icotinib). In some embodiments, attenuated antagonistic ErbB1 signaling is more on-target and has less side effects than other agents targeting receptors for EGF.

In some embodiments, the modified signaling agent has reduced affinity and/or activity (e.g. antagonistic e.g. natural antagonistic activity or antagonistic activity that is the result of one or more mutations, see, e.g., WO 2015/007520, the entire contents of which are hereby incorporated by reference) for ErbB1 and/or substantially reduced or ablated affinity and/or activity for ErbB4 or other subtypes it may interact with. Through specific targeting via the targeting moiety, cell-selective suppression (antagonism e.g. natural antagonistic activity or antagonistic activity that is the result of one or more mutations, see, e.g., WO 2015/007520, the entire contents of which are hereby incorporated by reference) of ErbB1/ErbB1 receptor activation would be achieved—while not engaging other receptor subtypes potentially associated with inhibition-associated side effects. Hence, in contrast to EGFR kinase inhibitors, which inhibit EGFR activity in all cell types in the body, such a construct would provide a cell-selective (e.g., tumor cell with activated EGFR signaling due to amplification of receptor, overexpression etc.) anti-EGFR (ErbB1) drug effect with reduced side effects.

In some embodiments, the modified signaling agent has reduced affinity and/or activity (e.g. agonistic) for ErbB4 and/or other subtypes it may interact with. Through targeting to specific target cells through the targeting moiety, a selective activation of ErbB1 signaling is achieved (e.g. epithelial cells). Such a construct finds use, in some embodiments, in the treatment of wounds (promoting would healing) with reduced side effects, especially for treatment of chronic conditions and application other than topical application of a therapeutic (e.g. systemic wound healing).

In an embodiment, the modified signaling agent is insulin or insulin analogs. In some embodiments, the modified insulin or insulin analog has reduced affinity and/or activity for the insulin receptor and/or IGF1 or IGF2 receptor.

In some embodiments, the modified insulin or insulin analog has substantially reduced or ablated affinity and/or activity for the insulin receptor and/or IGF1 or IGF2 receptor. Attenuated response at the insulin receptor allows for the control of diabetes, obesity, metabolic disorders and the like while directing away from IGF1 or IGF2 receptor avoids pro-cancer effects.

In an embodiment, the modified signaling agent is insulin-like growth factor-I or insulin-like growth factor-II (IGF-1 or IGF-2). In an embodiment, the modified signaling agent is IGF-1. In such an embodiment, the modified signaling agent has reduced affinity and/or activity for the insulin receptor and/or IGF1 receptor. In an embodiment, the modified signaling agent may bind to the IGF1 receptor and antagonize the activity of the receptor. In such an embodiment, the modified signaling agent has reduced affinity and/or activity for IGF1 receptor which allows for the activity of the receptor to be antagonized in an attenuated fashion. In some embodiments, the modified signaling agent has substantially reduced or ablated affinity and/or activity for the insulin receptor and/or IGF1 receptor. In some embodiments, the modified signaling agent has reduced affinity and/or activity for IGF2 receptor which allows for the activity of the receptor to be antagonized in an attenuated fashion. In an embodiment, the modified signaling agent has substantially reduced or ablated affinity and/or activity for the insulin receptor and accordingly does not interfere with insulin signaling. In various embodiments, this applies to cancer treatment. In various embodiments, the present agents may prevent IR isoform A from causing resistance to cancer treatments.

In one embodiment, the present chimeric protein has (i) a targeting moiety against Clec9A and (ii) a targeting moiety which is directed against a tumor cell, along with any of the modified or mutant signaling agents described herein. In an embodiment, the present chimeric protein has a targeting moiety directed against Clec9A on dendritic cells and a second targeting moiety directed against PD-L1 or PD-L2 on tumor cells.

In one embodiment, the present chimeric protein has (i) a targeting moiety against Clec9A and (ii) a targeting moiety which is directed against a checkpoint inhibitor marker, along with any of the modified or mutant interferons described herein. In an embodiment, the present chimeric protein has a targeting moiety directed against Clec9A on dendritic cells and a second targeting moiety directed against PD-1.

In various embodiments, the signaling agent is a toxin or toxic enzyme. In some embodiments, the toxin or toxic enzyme is derived from plants and bacteria. Illustrative toxins or toxic enzymes include, but are not limited to, the diphtheria toxin, *Pseudomonas* toxin, anthrax toxin, ribosome-inactivating proteins (RIPs) such as ricin and saporin, modeccin, abrin, gelonin, and poke weed antiviral protein. Additional toxins include those disclosed in Mathew et al., (2009) Cancer Sci 100(8): 1359-65, the entire disclosures are hereby incorporated by reference. In such embodiments, the chimeric proteins of the invention may be utilized to induce cell death in cell-type specific manner. In such embodiments, the toxin may be modified, e.g. mutated, to reduce affinity and/or activity of the toxin for an attenuated effect, as described with other signaling agents herein.

Multi-Specific Chimeras and Fusions with Signaling Agents

In various embodiments, the Clec9A binding agent of the invention is part of a chimera or fusion with one or more signaling agents as described herein and/or one or more additional targeting moieties. Accordingly, the present invention provides for chimeric or fusion proteins that include one or more signaling agents and a targeting moiety against Clec9A and/or one or more additional targeting moieties.

In various embodiments, the Clec9A binding agent of the invention is multispecific, i.e., the Clec9A binding agent comprises two or more targeting moieties having recognition domains that recognize and bind two or more targets, e.g. antigens, or receptors, or epitopes. In such embodiments, the Clec9A binding agent of the invention may comprise two more targeting moieties having recognition domains that recognize and bind two or more epitopes on the same antigen or on different antigens. In various embodiments, such multi-specific Clec9A binding agents exhibit advantageous properties such as increased avidity and/or improved selectivity. In an embodiment, the Clec9A binding agent of the invention comprises two targeting moieties and is bispecific, i.e., binds and recognizes two epitopes on the same antigen or on different antigens.

In various embodiments, the multispecific Clec9A binding agent of the invention comprises two or more targeting moieties with each targeting moiety being an antibody or an antibody derivative as described herein. In an embodiment, the multispecific Clec9A binding agent of the invention comprises at least one VHH comprising an antigen recognition domain against Clec9A and one antibody or antibody derivative comprising an antigen recognition domain against a tumor antigen.

In various embodiments, the present multispecific Clec9A binding agents have two or more targeting moieties that target different antigens or receptors, and one targeting moiety may be attenuated for its antigen or receptor, e.g. the targeting moiety binds its antigen or receptor with a low affinity or avidity (including, for example, at an affinity or avidity that is less than the affinity or avidity the other targeting moiety has for its for its antigen or receptor, for instance the difference between the binding affinities may be about 10-fold, or 25-fold, or 50-fold, or 100-fold, or 300-fold, or 500-fold, or 1000-fold, or 5000-fold; for instance the lower affinity or avidity targeting moiety may bind its antigen or receptor at a $K_D$ in the mid- to high-nM or low- to mid-NM range while the higher affinity or avidity targeting moiety may bind its antigen or receptor at a $K_D$ in the mid- to high-pM or low- to mid-nM range). For instance, in some embodiments, the present multispecific Clec9A binding agents comprises an attenuated targeting moiety that is directed against a promiscuous antigen or receptor, which may improve targeting to a cell of interest (e.g. via the other targeting moiety) and prevent effects across multiple types of cells, including those not being targeted for therapy (e.g. by binding promiscuous antigen or receptor at a higher affinity than what is provided in these embodiments).

The multispecific Clec9A binding agent of the invention may be constructed using methods known in the art, see for example, U.S. Pat. No. 9,067,991, U.S. Patent Publication No. 20110262348 and WO 2004/041862, the entire contents of which are hereby incorporated by reference. In an illustrative embodiment, the multispecific Clec9A binding agent of the invention comprising two or more targeting moieties may be constructed by chemical crosslinking, for example, by reacting amino acid residues with an organic derivatizing agent as described by Blattler et al., Biochemistry 24, 1517-1524 and EP294703, the entire contents of which are hereby incorporated by reference. In another illustrative embodiment, the multispecific Clec9A binding agent comprising two or more targeting moieties is constructed by genetic fusion, i.e., constructing a single polypeptide which includes the polypeptides of the individual targeting moieties. For example, a single polypeptide construct may be formed which encodes a first VHH with an antigen recognition domain against Clec9A and a second antibody or antibody derivative with an antigen recognition domain against a tumor antigen. A method for producing bivalent or multivalent VHH polypeptide constructs is disclosed in PCT patent application WO 96/34103, the entire contents of which is hereby incorporated by reference. In a further illustrative embodiment, the multispecific Clec9A binding agent of the invention may be constructed by using linkers. For example, the carboxy-terminus of a first VHH with an antigen recognition domain against Clec9A may be linked to the amino-terminus of a second antibody or antibody derivative with an antigen recognition domain against a tumor antigen (or vice versa). Exemplary linkers that may be used are described herein. In some embodiments, the components of the multispecific Clec9A binding agent of the invention are directly linked to each other without the use of linkers.

In various embodiments, the multi-specific Clec9A binding agent of the invention recognizes and binds to Clec9A and one or more antigens found on one or more immune cells, which can include, without limitation, megakaryocytes, thrombocytes, erythrocytes, mast cells, basophils, neutrophils, eosinophils, monocytes, macrophages, natural killer cells, T lymphocytes (e.g., cytotoxic T lymphocytes, T helper cells, natural killer T cells), B lymphocytes, plasma cells, dendritic cells, or subsets thereof. In some embodiments, the Clec9A binding agent specifically binds to an antigen of interest and effectively directly or indirectly recruits one of more immune cells.

In various embodiments, the multi-specific Clec9A binding agent of the invention recognizes and binds to Clec9A and one or more antigens found on tumor cells. In these embodiments, the present Clec9A binding agents may directly or indirectly recruit an immune cell to a tumor cell or the tumor microenvironment. In some embodiments, the present Clec9A binding agents may directly or indirectly recruit an immune cell, e.g. an immune cell that can kill and/or suppress a tumor cell (e.g., a CTL), to a site of action (such as, by way of non-limiting example, the tumor microenvironment).

In some embodiments, the present Clec9A binding agents are capable of, or find use in methods involving, shifting the balance of immune cells in favor of immune attack of a tumor. For instance, the present Clec9A binding agents can shift the ratio of immune cells at a site of clinical importance in favor of cells that can kill and/or suppress a tumor (e.g. T cells, cytotoxic T lymphocytes, T helper cells, natural killer (NK) cells, natural killer T (NKT) cells, anti-tumor macrophages (e.g. M1 macrophages), neutrophils, B cells, dendritic cells or subsets thereof and in opposition to cells that protect tumors (e.g. myeloid-derived suppressor cells (MDSCs), regulatory T cells (Tregs); tumor associated neutrophils (TANs), M2 macrophages, tumor associated macrophages (TAMs), or subsets thereof). In some embodiments, the present Clec9A binding agent is capable of increasing a ratio of effector T cells to regulatory T cells.

In some embodiments, the multi-specific Clec9A binding agent of the invention comprises a targeting moiety having an antigen recognition domain that specifically binds to an antigen associated with tumor cells. In some embodiments, the targeting moiety directly or indirectly recruits tumor cells. For instance, in some embodiments, the recruitment of the tumor cell is to one or more effector cell (e.g. an immune cell as described herein) that can kill and/or suppress the tumor cell. In some embodiments, the targeting moiety directly or indirectly recruits T cells to a tumor cell, for example, by virtue of the two targeting moieties interacting with their respective antigens on a tumor and Clec9A-positive immune cell (e.g. dendritic cells).

Tumor cells, or cancer cells refer to an uncontrolled growth of cells or tissues and/or an abnormal increased in cell survival and/or inhibition of apoptosis which interferes with the normal functioning of bodily organs and systems. For example, tumor cells include benign and malignant cancers, polyps, hyperplasia, as well as dormant tumors or micrometastases. Illustrative tumor cells include, but are not limited to cells of: basal cell carcinoma, biliary tract cancer; bladder cancer; bone cancer; brain and central nervous system cancer; breast cancer; cancer of the peritoneum; cervical cancer; choriocarcinoma; colon and rectum cancer; connective tissue cancer; cancer of the digestive system; endometrial cancer; esophageal cancer; eye cancer; cancer of the head and neck; gastric cancer (including gastrointestinal cancer); glioblastoma; hepatic carcinoma; hepatoma; intra-epithelial neoplasm; kidney or renal cancer; larynx cancer; leukemia; liver cancer; lung cancer (e.g., small-cell lung cancer, non-small cell lung cancer, adenocarcinoma of the lung, and squamous carcinoma of the lung); melanoma; myeloma; neuroblastoma; oral cavity cancer (lip, tongue, mouth, and pharynx); ovarian cancer; pancreatic cancer; prostate cancer; retinoblastoma; rhabdomyosarcoma; rectal cancer; cancer of the respiratory system; salivary gland carcinoma; sarcoma; skin cancer; squamous cell cancer; stomach cancer; testicular cancer; thyroid cancer; uterine or endometrial cancer; cancer of the urinary system; vulval cancer; lymphoma including Hodgkin's and non-Hodgkin's lymphoma, as well as B-cell lymphoma (including low grade/follicular non-Hodgkin's lymphoma (NHL); small lymphocytic (SL) NHL; intermediate grade/follicular NHL; intermediate grade diffuse NHL; high grade immunoblastic NHL; high grade lymphoblastic NHL; high grade small non-cleaved cell NHL; bulky disease NHL; mantle cell lymphoma; AIDS-related lymphoma; and Waldenstrom's Macroglobulinemia; chronic lymphocytic leukemia (CLL); acute lymphoblastic leukemia (ALL); Hairy cell leukemia; chronic myeloblastic leukemia; as well as other carcinomas and sarcomas; and post-transplant lymphoproliferative disorder (PTLD), as well as abnormal vascular proliferation associated with phakomatoses, edema (e.g. that associated with brain tumors), and Meigs' syndrome.

Tumor cells, or cancer cells also include, but are not limited to, carcinomas, e.g. various subtypes, including, for example, adenocarcinoma, basal cell carcinoma, squamous cell carcinoma, and transitional cell carcinoma), sarcomas (including, for example, bone and soft tissue), leukemias (including, for example, acute myeloid, acute lymphoblastic, chronic myeloid, chronic lymphocytic, and hairy cell), lymphomas and myelomas (including, for example, Hodgkin and non-Hodgkin lymphomas, light chain, non-secretory, MGUS, and plasmacytomas), and central nervous system cancers (including, for example, brain (e.g. gliomas (e.g. astrocytoma, oligodendroglioma, and ependymoma), meningioma, pituitary adenoma, and neuromas, and spinal cord tumors (e.g. meningiomas and neurofibroma).

Illustrative tumor antigens include, but are not limited to, MART-1/Melan-A, gp100, Dipeptidyl peptidase IV (DP-PIV), adenosine deaminase-binding protein (ADAbp), cyclophilin b, Colorectal associated antigen (CRC)-0017-1A/GA733, Carcinoembryonic Antigen (CEA) and its immunogenic epitopes CAP-1 and CAP-2, etv6, aml1, Prostate Specific Antigen (PSA) and its immunogenic epitopes PSA-1, PSA-2, and PSA-3, prostate-specific membrane antigen (PSMA), T-cell receptor/CD3-zeta chain, MAGE-family of tumor antigens (e.g., MAGE-A1, MAGE-A2, MAGE-A3, MAGE-A4, MAGE-A5, MAGE-A6, MAGE-A7, MAGE-A8, MAGE-A9, MAGE-A10, MAGE-A11, MAGE-A12, MAGE-Xp2 (MAGE-B2), MAGE-Xp3 (MAGE-B3), MAGE-Xp4 (MAGE-B4), MAGE-C1, MAGE-C2, MAGE-C3, MAGE-C4, MAGE-C5), GAGE-family of tumor antigens (e.g., GAGE-1, GAGE-2, GAGE-3, GAGE-4, GAGE-5, GAGE-6, GAGE-7, GAGE-8, GAGE-9), BAGE, RAGE, LAGE-1, NAG, GnT-V, MUM-1, CDK4, tyrosinase, p53, MUC family, HER2/neu, p21ras, RCAS1, α-fetoprotein, E-cadherin, α-catenin, β-catenin and γ-catenin, p120ctn, gp100 Pme117, PRAME, NY-ESO-1, cdc27, adenomatous polyposis coli protein (APC), fodrin, Connexin 37, Ig-idiotype, p15, gp75, GM2 and GD2 gangliosides, viral products such as human papilloma virus proteins, Smad family of tumor antigens, Imp-1, NA, EBV-encoded nuclear antigen (EBNA)-1, brain glycogen phosphorylase, SSX-1, SSX-2 (HOM-MEL-40), SSX-1, SSX-4, SSX-5, SCP-1 CT-7, c-erbB-2, CD19, CD20, CD22, CD30, CD33, CD37, CD56, CD70, CD74, CD138, AGS16, MUC1, GPNMB, Ep-CAM, PD-L1, PD-L2, PMSA, and BCMA (TNFRSF17). In various embodiments, the Clec9A binding agent comprises a targeting moiety that binds one or more of these tumor antigens.

In some embodiments, the present multi-specific Clec9A binding agent recognizes and binds to Clec9A as well as an antigen on a tumor cell. In some embodiments, the multi-specific Clec9A binding agent directly or indirectly recruits CTLs to the tumor cell or tumor microenvironment.

In various embodiments, the present multi-specific Clec9A binding agent has targeting moieties which target two different cells (e.g. to make a synapse) or the same cell (e.g. to get a more concentrated signaling agent effect).

In some embodiments, the multi-specific Clec9A binding agent of the invention comprises a targeting moiety having an antigen recognition domain that specifically binds to a target (e.g. antigen, receptor) associated with T cells. In some embodiments, the targeting moiety recruits directly or indirectly T cells. In an embodiment, the antigen recognition domains specifically bind to effector T cells. In some embodiments, the antigen recognition domain directly or indirectly recruits effector T cells, e.g., in some embodiments, to a therapeutic site (e.g. a locus with one or more disease cell or cell to be modulated for a therapeutic effect). Illustrative effector T cells include cytotoxic T cells (e.g. αβ TCR, CD3$^+$, CD8$^+$, CD45RO$^+$); CD4$^+$ effector T cells (e.g. as TCR, CD3$^+$, CD4$^+$, CCR7$^+$, CD62Lhi, IL-7R/CD127$^+$); CD8$^+$ effector T cells (e.g. as TCR, CD3$^+$, CD8$^+$, CCR7$^+$, CD62Lhi, IL-7R/CD127$^+$); effector memory T cells (e.g. CD62Llow, CD44$^+$, TCR, CD3$^+$, IL-7R/CD127$^+$, IL-15R$^+$, CCR7low); central memory T cells (e.g. CCR7$^+$, CD62L$^+$, CD27$^+$; or CCR7hi, CD44$^+$, CD62Lhi, TCR, CD3$^+$, IL-7R/CD127$^+$, IL-15R$^+$); CD62L$^+$ effector T cells; CD8$^+$ effector memory T cells (TEM) including early effector memory T cells (CD27$^+$CD62L$^-$) and late effector memory T cells (CD27$^-$ CD62L$^-$) (TemE and TemL, respectively); CD127 ($^+$)CD25(low/-) effector T cells; CD127($^-$)CD25($^-$) effector T cells; CD8$^+$ stem cell memory effector cells (TSCM) (e.g. CD44(low)CD62L(high)CD122(high)sca($^+$)); TH1 effector T-cells (e.g. CXCR3$^+$, CXCR6$^+$ and CCR5$^+$; or as TCR, CD3$^+$, CD4$^+$, IL-12R$^+$, IFNγR$^+$, CXCR3$^+$), TH2 effector T cells (e.g. CCR3$^+$, CCR4$^+$ and CCR8$^+$; or as TCR, CD3$^+$, CD4$^+$, IL-4R$^+$, IL-33R$^+$, CCR4$^+$, IL-17RB$^+$, CRTH2$^+$); TH9 effector T cells (e.g. as TCR, CD3$^+$, CD4$^+$); TH17 effector T cells (e.g. as TCR, CD3$^+$, CD4$^+$, IL-23R$^+$, CCR6$^+$, IL-1R$^+$); CD4$^+$CD45RO$^+$CCR7$^+$ effector T cells, ICOS$^+$ effector T cells; CD4$^+$CD45RO$^+$CCR7($^-$) effector T cells; and effector T cells secreting IL-2, IL-4 and/or IFN-γ.

Illustrative T cell antigens of interest include, for example (and inclusive of the extracellular domains, where applicable): CD8, CD3, SLAMF4, IL-2Rα, 4-1BB/TNFRSF9, IL-2 Rβ, ALCAM, B7-1, IL-4 R, B7-H3, BLAME/SLAMF8, CEACAM1, IL-6 R, CCR3, IL-7 Rα, CCR4, CXCRI/IL-S RA, CCR5, CCR6, IL-10Rα, CCR 7, IL-l0 Rβ, CCRS, IL-12 Rβ1, CCR9, IL-12 Rβ2, CD2, IL-13 Rα1, IL-13, CD3, CD4, ILT2/CDS5j, ILT3/CDS5k, ILT4/CDS5d, ILT5/CDS5a, lutegrin α 4/CD49d, CDS, Integrin α E/CD103, CD6, Integrin a M/CD 11 b, CDS, Integrin α X/CD11c, Integrin β 2/CDIS, KIR/CD15S, CD27/TN-FRSF7, KIR2DL1, CD2S, KIR2DL3, CD30/TNFRSFS, KIR2DL4/CD15Sd, CD31/PECAM-1, KIR2DS4, CD40 Ligand/TNFSF5, LAG-3, CD43, LAIR1, CD45, LAIR2, CDS3, Leukotriene B4-R1, CDS4/SLAMF5, NCAM-L1, CD94, NKG2A, CD97, NKG2C, CD229/SLAMF3, NKG2D, CD2F-10/SLAMF9, NT-4, CD69, NTB-A/SLAMF6, Common γ Chain/IL-2 Rγ, Osteopontin, CRACC/SLAMF7, PD-1, CRTAM, PSGL-1, CTLA-4, RANK/

TNFRSF11A, CX3CR1, CX3CL1, L-Selectin, CXCR3, SIRP β1, CXCR4, SLAM, CXCR6, TCCR/WSX-1, DNAM-1, Thymopoietin, EMMPRIN/CD147, TIM-1, EphB6, TIM-2, Fas/TNFRSF6, TIM-3, Fas Ligand/TNFSF6, TIM-4, Fcγ RIII/CD16, TIM-6, TNFR1/TNFRSF1A, Granulysin, TNF RIII/TNFRSF1B, TRAIL RI/TNFRSFIOA, ICAM-1/CD54, TRAIL R2/TNFRSF10B, ICAM-2/CD102, TRAILR3/TNFRSF10C, IFN-γR1, TRAILR4/TNFRSF10D, IFN-γ R2, TSLP, IL-1 R1 and TSLP R. In various embodiments, the Clec9A binding agent comprises a targeting moiety that binds one or more of these illustrative T cell antigens.

In some embodiments, the multi-specific Clec9A binding agent of the invention comprises a targeting moiety against CD8 which is a VHH comprising a single amino acid chain having four "framework regions" or FRs and three "complementary determining regions" or CDRs. As used herein, "framework region" or "FR" refers to a region in the variable domain which is located between the CDRs. As used herein, "complementary determining region" or "CDR" refers to variable regions in VHHs that contains the amino acid sequences capable of specifically binding to antigenic targets.

In various embodiments, the multi-specific Clec9A binding agent of the invention comprises a VHH against CD8 having a variable domain comprising at least one CDR1, CDR2, and/or CDR3 sequences.

In some embodiments, the CDR1 sequence is selected from SEQ ID NO: 362 or (SEQ ID NO: 18).

In some embodiments, the CDR2 sequence is selected from (SEQ ID NO: 363) or (SEQ ID NO: 364).

In some embodiments, the CDR3 sequence is selected from SEQ ID NO: 365) or (SEQ ID NO: 366) or (SEQ ID NO: 367).

In various embodiments, the CD8 targeting moiety comprises an amino acid sequence selected from the following sequences R3HCD27 (SEQ ID NO: 368) or R3HCD129 (SEQ ID NO: 369) or R2HCD26 (SEQ ID NO: 370).

In some embodiments, the CD8 targeting moiety comprises a VHH having a variable domain comprising at least one CDR1, CDR2, and/or CDR3 sequences as described below.

In some embodiments, the CDR1 sequence is selected from SEQ ID NO: 371 to SEQ ID NO: 438 or SEQ ID NO: 52.

In some embodiments, the CDR2 sequence is selected from SEQ ID NO: 439 to SEQ ID NO: 507.

In some embodiments, the CDR3 sequence is selected from SEQ ID NO: 508 to SEQ ID NO: 576.

In various embodiments, the CD8 targeting moiety comprises an amino acid sequence selected from the following sequences 1CDA 7 (SEQ ID NO: 577) or 1CDA 12 (SEQ ID NO: 578) or 1CDA 14 (SEQ ID NO: 579) or 1CDA 15 (SEQ ID NO: 580) or 1CDA 17 (SEQ ID NO: 581) or 1CDA 18 (SEQ ID NO: 582) or 1CDA 19 (SEQ ID NO: 583) or 1CDA 24 (SEQ ID NO: 584) or 1CDA 26 (SEQ ID NO: 585) or 1CDA 28 (SEQ ID NO: 586) or 1CDA 37 (SEQ ID NO: 587) or 1CDA 43 (SEQ ID NO: 588) or 1CDA 45 (SEQ ID NO: 589) or 1CDA 47 (SEQ ID NO: 590) or 1CDA 48 (SEQ ID NO: 591) or 1CDA 58 (SEQ ID NO: 592) or 1CDA 65 (SEQ ID NO: 593) or 1CDA 68 (SEQ ID NO: 594) or 1CDA 73 (SEQ ID NO: 595) or 1CDA 75 (SEQ ID NO: 596) or 1CDA 86 (SEQ ID NO: 597) or 1CDA 87 (SEQ ID NO: 598) or 1CDA 88 (SEQ ID NO: 599) or 1CDA 89 (SEQ ID NO: 600) or 1CDA 92 (SEQ ID NO: 601) or 1CDA 93 (SEQ ID NO: 602) or 2CDA 1 (SEQ ID NO: 603) or 2CDA 5 (SEQ ID NO: 604) or 2CDA 22 (SEQ ID NO: 605) or 2CDA 28 (SEQ ID NO: 606) or 2CDA 62 (SEQ ID NO: 607) or 2CDA 68 (SEQ ID NO: 608) or 2CDA 73 (SEQ ID NO: 609) or 2CDA 74 (SEQ ID NO: 610) or 2CDA 75 (SEQ ID NO: 611) or 2CDA 77 (SEQ ID NO: 612) or 2CDA 81 (SEQ ID NO: 613) or 2CDA 87 (SEQ ID NO: 614) or 2CDA 88 (SEQ ID NO: 615) or 2CDA 89 (SEQ ID NO: 616) or 2CDA 91 (SEQ ID NO: 617) or 2CDA 92 (SEQ ID NO: 618) or 2CDA 93 (SEQ ID NO: 619) or 2CDA 94 (SEQ ID NO: 620) or 2CDA 95 (SEQ ID NO: 621) or 3CDA 3 (SEQ ID NO: 622) or 3CDA 8 (SEQ ID NO: 623) or 3CDA 11 (SEQ ID NO: 624) or 3CDA 18 (SEQ ID NO: 625) or 3CDA 19 (SEQ ID NO: 626) or 3CDA 21 (SEQ ID NO: 627) or 3CDA 24 (SEQ ID NO: 628) or 3CDA 28 (SEQ ID NO: 629) or 3CDA 29 (SEQ ID NO: 630) or 3CDA 31 (SEQ ID NO: 631) or 3CDA 32 (SEQ ID NO: 632) or 3CDA 33 (SEQ ID NO: 633) or 3CDA 37 (SEQ ID NO: 634) or 3CDA 40 (SEQ ID NO: 635) or 3CDA 41 (SEQ ID NO: 636) or 3CDA 48 (SEQ ID NO: 637) or 3CDA 57 (SEQ ID NO: 638) or 3CDA 65 (SEQ ID NO: 639) or 3CDA 70 (SEQ ID NO: 640) or 3CDA 73 (SEQ ID NO: 641) or 3CDA 83 (SEQ ID NO: 642) or 3CDA 86 (SEQ ID NO: 643) or 3CDA 88 (SEQ ID NO: 644) or 3CDA 90 (SEQ ID NO: 645). In various exemplary embodiments, the CD8 targeting moiety comprises an amino acid sequence selected from any one of the above sequences without the terminal histidine tag sequence (i.e., HHHHHH; SEQ ID NO: 324).

In some embodiments, the CD8 targeting moiety comprises an amino acid sequence selected from SEQ ID Nos: 577-645 (provided above) without the HA tag (i.e., YPYDVPDYGS; SEQ ID NO: 325).

In some embodiments, the CD8 targeting moiety comprises an amino acid sequence selected from SEQ ID Nos: 577-645 (provided above) without the AAA linker (i.e., AAA).

In some embodiments, the CD8 targeting moiety comprises an amino acid sequence selected from SEQ ID Nos: 577-645 (provided above) without the AAA linker, HA tag, and terminal histidine tag sequence (i.e., AAAY-PYDVPDYGSHHHHHH; SEQ ID NO: 326). In various embodiments, the CD8 targeting moiety comprises an amino acid sequence described in US Patent Publication No. 2014/0271462, the entire contents of which are incorporated by reference. In various embodiments, the CD8 targeting moiety comprises an amino acid sequence described in Table 0.1, Table 0.2, Table 0.3, and/or FIGS. 1A-12I of US Patent Publication No. 2014/0271462, the entire contents of which are incorporated by reference. In various embodiments, the CD8 targeting moiety comprises a HCDR1 of a HCDR1 of SEQ ID NO: 646 or 647 and/or a HCDR2 of HCDR1 of SEQ ID NO: 646 or 647 and/or a HCDR3 of HCDR1 of SEQ ID NO: 646 or 647 and/or a LCDR1 of LCDR1 of SEQ ID NO: 648 and/or a LCDR2 of LCDR1 of SEQ ID NO: 648 and/or a LCDR3 of LCDR1 of SEQ ID NO: 648, as provided below.

In various embodiments, the present invention contemplates the use of any natural or synthetic analogs, mutants, variants, alleles, homologs and orthologs (herein collectively referred to as "analogs") of the targeting moiety directed against CD8 as described herein. In various embodiments, the amino acid sequence of the targeting moiety directed against CD8 further includes an amino acid analog, an amino acid derivative, or other non-classical amino acids.

In some embodiments, the multi-specific Clec9A binding agent of the invention comprises a targeting moiety having an antigen recognition domain that specifically binds to a target (e.g. antigen, receptor) associated with B cells. In some embodiments, the targeting moiety directly or indirectly recruits B cells, e.g., in some embodiments, to a therapeutic site (e.g. a locus with one or more disease cell or cell to be modulated for a therapeutic effect).

Illustrative B cell antigens of interest include, for example, CD10, CD19, CD20, CD21, CD22, CD23, CD24, CD37, CD38, CD39, CD40, CD70, CD72, CD73, CD74, CDw75, CDw76, CD77, CD78, CD79a/b, CD80, CD81, CD82, CD83, CD84, CD85, CD86, CD89, CD98, CD126, CD127, CDw130, CD138, CDw150, and B-cell maturation antigen (BCMA). In various embodiments, the Clec9A binding agent comprises a targeting moiety that binds one or more of these illustrative B cell antigens.

In some embodiments, the multi-specific Clec9A binding agent of the invention comprises a targeting moiety having an antigen recognition domain that specifically bind to a target (e.g. antigen, receptor) associated with Natural Killer cells. In some embodiments, the targeting moiety directly or indirectly recruits Natural Killer cells, e.g., in some embodiments, to a therapeutic site (e.g. a locus with one or more disease cell or cell to be modulated for a therapeutic effect). Illustrative Natural Killer cell antigens of interest include, for example TIGIT, 2B4/SLAMF4, KIR2DS4, CD155/PVR, KIR3DL1, CD94, LMIR1/CD300A, CD69, LMIR2/CD300c, CRACC/SLAMF7, LMIR3/CD300LF, Kir1alpha, DNAM-1, LMIR5/CD300LB, Fc-epsilon RII, LMIR6/CD300LE, Fc-γ RI/CD64, MICA, Fc-γ RIIB/CD32b, MICB, Fc-γ RIIC/CD32c, MULT-1, Fc-γ RIIA/CD32a, Nectin-2/CD112, Fc-γ RIII/CD16, NKG2A, FcRH1/IRTA5, NKG2C, FcRH2/IRTA4, NKG2D, FcRH4/IRTA1, NKp30, FcRH5/IRTA2, NKp44, Fc-Receptor-like 3/CD16-2, NKp46/NCR1, NKp80/KLRF1, NTB-A/SLAMF6, Rae-1, Rae-1α, Rae-1β, Rae-1 delta, H60, Rae-1 epsilon, ILT2/CD85j, Rae-1γ, ILT3/CD85k, TREM-1, ILT4/CD85d, TREM-2, ILT5/CD85a, TREM-3, KIR/CD158, TREML1/TLT-1, KIR2DL1, ULBP-1, KIR2DL3, ULBP-2, KIR2DL4/CD158d and ULBP-3. In various embodiments, the Clec9A binding agent comprises a targeting moiety that binds one or more of these illustrative NK cell antigens.

In some embodiments, the multi-specific Clec9A binding agent of the invention comprises a targeting moiety having an antigen recognition domain that specifically binds to a target (e.g. antigen, receptor) associated with macrophages/monocytes. In some embodiments, the targeting moiety directly or indirectly recruits macrophages/monocytes, e.g., in some embodiments, to a therapeutic site (e.g. a locus with one or more disease cell or cell to be modulated for a therapeutic effect). Illustrative macrophages/monocyte antigens of interest include, for example SIRP1a, B7-1/CD80, ILT4/CD85d, B7-H1, ILT5/CD85a, Common β Chain, Integrin α 4/CD49d, BLAME/SLAMF8, Integrin α X/CDIIc, CCL6/C10, Integrin β 2/CD18, CD155/PVR, Integrin β 3/CD61, CD31/PECAM-1, Latexin, CD36/SR-B3, Leukotriene B4 R1, CD40/TNFRSF5, LIMPIIISR-B2, CD43, LMIR1/CD300A, CD45, LMIR2/CD300c, CD68, LMIR3/CD300LF, CD84/SLAMF5, LMIR5/CD300LB, CD97, LMIR6/CD300LE, CD163, LRP-1, CD2F-10/SLAMF9, MARCO, CRACC/SLAMF7, MD-1, ECF-L, MD-2, EMMPRIN/CD147, MGL2, Endoglin/CD105, Osteoactivin/GPNMB, Fc-γ RI/CD64, Osteopontin, Fc-γ RIIB/CD32b, PD-L2, Fc-γ RIIC/CD32c, Siglec-3/CD33, Fc-γ RIIA/CD32a, SIGNR1/CD209, Fc-γ RIII/CD16, SLAM, GM-CSF R α, TCCR/WSX-1, ICAM-2/CD102, TLR3, IFN-γ RI, TLR4, IFN-gannna R2, TREM-1, IL-I RII, TREM-2, ILT2/CD85j, TREM-3, ILT3/CD85k, TREML1/TLT-1, 2B4/SLAMF 4, IL-10 R α, ALCAM, IL-10 Rβ, Aminopeptida-seN/ANPEP, ILT2/CD85j, Common β Chain, ILT3/CD85k, Clq R1/CD93, ILT4/CD85d, CCR1, ILT5/CD85a, CCR2, CD206, Integrin α 4/CD49d, CCR5, Integrin α M/CDII b, CCR8, Integrin α X/CDIIc, CD155/PVR, Integrin β 2/CD18, CD14, Integrin β 3/CD61, CD36/SR-B3, LAIR1, CD43, LAIR2, CD45, Leukotriene B4-R1, CD68, LIMPII-ISR-B2, CD84/SLAMF5, LMIR1/CD300A, CD97, LMIR2/CD300c, CD163, LMIR3/CD300LF, Coagulation Factor Ill/Tissue Factor, LMIR5/CD300LB, CX3CR1, CX3CL1, LMIR6/CD300LE, CXCR4, LRP-1, CXCR6, M-CSF R, DEP-1/CD148, MD-1, DNAM-1, MD-2, EMMPRIN/CD147, MMR, Endoglin/CD105, NCAM-L1, Fc-γ RI/CD64, PSGL-1, Fc-γ RIIICD16, RP105, G-CSF R, L-Selectin, GM-CSF R α, Siglec-3/CD33, HVEM/TN-FRSF14, SLAM, ICAM-1/CD54, TCCR/WSX-1, ICAM-2/CD102, TREM-I, IL-6 R, TREM-2, CXCRI/IL-8 RA, TREM-3 and TREML1/TLT-1. In various embodiments, the Clec9A binding agent comprises a targeting moiety that binds one or more of these illustrative macrophage/monocyte antigens.

In some embodiments, the multi-specific Clec9A binding agent of the invention comprises a targeting moiety having an antigen recognition domain that specifically binds to a target (e.g. antigen, receptor) associated with dendritic cells. In some embodiments, the targeting moiety directly or indirectly recruits dendritic cells, e.g., in some embodiments, to a therapeutic site (e.g. a locus with one or more disease cell or cell to be modulated for a therapeutic effect). Illustrative dendritic cell antigens of interest include, for example, CLEC9A, XCR1, RANK, CD36/SRB3, LOX-1/SR-E1, CD68, MARCO, CD163, SR-A1/MSR, CD5L, SREC-1, CL-PI/COLEC12, SREC-II, LIMPIIISRB2, RP105, TLR4, TLR1, TLR5, TLR2, TLR6, TLR3, TLR9, 4-IBB Ligand/TNFSF9, IL-12/IL-23 p40, 4-Amino-1,8-naphthalimide, ILT2/CD85j, CCL21/6Ckine, ILT3/CD85k, 8-oxo-dG, ILT4/CD85d, 8D6A, ILT5/CD85a, A2B5, lutegrin a 4/CD49d, Aag, Integrin β 2/CD18, AMICA, Langerin, B7-2/CD86, Leukotriene B4 RI, B7-H3, LMIR1/CD300A, BLAME/SLAMF8, LMIR2/CD300c, Clq R1/CD93, LMIR3/CD300LF, CCR6, LMIR5/CD300LB CCR7, LMIR6/CD300LE, CD40/TNFRSF5, MAG/Siglec-4-a, CD43, MCAM, CD45, MD-1, CD68, MD-2, CD83, MDL-1/CLEC5A, CD84/SLAMF5, MMR, CD97, NCAMLI, CD2F-10/SLAMF9, Osteoactivin GPNMB, Chern 23, PD-L2, CLEC-1, RP105, CLEC-2, CLEC-8, Siglec-2/CD22, CRACC/SLAMF7, Siglec-3/CD33, DC-SIGN, DEC-205, Siglec-5, DC-SIGNR/CD299, Siglec-6, DCAR, Siglec-7, DCIR/CLEC4A, Siglec-9, DEC-205, Siglec-10, Dectin-1/CLEC7A, Siglec-F, Dectin-2/CLEC6A, SIGNR1/CD209, DEP-1/CD148, SIGNR4, DLEC, SLAM, EMM-PRIN/CD147, TCCR/WSX-1, Fc-γ R1/CD64, TLR3, Fc-γ RIIB/CD32b, TREM-1, Fc-γ RIIC/CD32c, TREM-2, Fc-γ RIIA/CD32a, TREM-3, Fc-γ RIII/CD16, TREML1/TLT-1, ICAM-2/CD102, DEC205, and Vanilloid R1. In various embodiments, the Clec9A binding agent comprises a targeting moiety that binds one or more of these illustrative DC antigens.

In various embodiments, the present chimeric protein comprises a targeting moiety comprising an amino acid sequence that is at least 60% identical to any one of the sequences disclosed herein. For example, the chimeric protein may comprise a targeting moiety comprising an amino acid sequence that is at least about 60%, at least about 61%, at least about 62%, at least about 63%, at least about 64%, at least about 65%, at least about 66%, at least about 67%, at least about 68%, at least about 69%, at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or 100% identical to any one of the sequences discloses herein (e.g. about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, about 99% or about 100% sequence identity to any one of the sequences disclosed herein).

In some embodiments, the multi-specific Clec9A binding agent of the invention comprises a targeting moiety having an antigen recognition domain that specifically binds a target (e.g. antigen, receptor) on immune cells selected from, but not limited to, megakaryocytes, thrombocytes, erythrocytes, mast cells, basophils, neutrophils, and eosinophils. In some embodiments, the antigen recognition domains directly or indirectly recruit megakaryocytes, thrombocytes, erythrocytes, mast cells, basophils, neutrophils, and eosinophil, e.g., in some embodiments, to a therapeutic site (e.g. a locus with one or more disease cell or cell to be modulated for a therapeutic effect).

In some embodiments, the multi-specific Clec9A binding agent of the invention comprises a targeting moiety having an antigen recognition domain that specifically binds to a target (e.g. antigen, receptor) associated with megakaryocytes and/or thrombocytes. Illustrative megakaryocyte and/or thrombocyte antigens of interest include, for example, GP Ib/IIIa, GPIb, vWF, PF4, and TSP. In various embodiments, the Clec9A binding agent comprises a targeting moiety that binds one or more of these illustrative megakaryocyte and/or thrombocyte antigens.

In some embodiments, the multi-specific Clec9A binding agent of the invention comprises a targeting moiety having an antigen recognition domain that specifically binds to a target (e.g. antigen, receptor) associated with erythrocytes. Illustrative erythrocyte antigens of interest include, for example, CD34, CD36, CD38, CD41a (platelet glycoprotein Ib/IIIa), CD41b (GPIIb), CD71 (transferrin receptor), CD105, glycophorin A, glycophorin C, c-kit, HLA-DR, H2 (MHC-II), and Rhesus antigens. In various embodiments, the Clec9A binding agent comprises a targeting moiety that binds one or more of these illustrative erythrocyte antigens.

In some embodiments, the multi-specific Clec9A binding agent of the invention comprises a targeting moiety having an antigen recognition domain that specifically binds to a target (e.g. antigen, receptor) associated with mast cells.

Illustrative mast cells antigens of interest include, for example, SCFR/CD117, $Fc_\varepsilon RI$, CD2, CD25, CD35, CD88, CD203c, C5R1, CMAI, FCERIA, FCER2, TPSABI. In various embodiments, the Clec9A binding agent comprises a targeting moiety that binds one or more of these mast cell antigens.

In some embodiments, the multi-specific Clec9A binding agent of the invention comprises a targeting moiety having an antigen recognition domain that specifically binds to a target (e.g. antigen, receptor) associated with basophils.

Illustrative basophils antigens of interest include, for example, $Fc_\varepsilon RI$, CD203c, CD123, CD13, CD107a, CD107b, and CD164. In various embodiments, the Clec9A binding agent comprises a targeting moiety that binds one or more of these basophil antigens.

In some embodiments, the multi-specific Clec9A binding agent of the invention comprises a targeting moiety having an antigen recognition domain that specifically binds to a target (e.g. antigen, receptor) associated with neutrophils.

Illustrative neutrophils antigens of interest include, for example, 7D5, CD10/CALLA, CD13, CD16 (FcRIII), CD18 proteins (LFA-1, CR3, and p150, 95), CD45, CD67, and CD177. In various embodiments, the Clec9A binding agent comprises a targeting moiety that binds one or more of these neutrophil antigens.

In some embodiments, the multi-specific Clec9A binding agent of the invention comprises a targeting moiety having an antigen recognition domain that specifically binds to a target (e.g. antigen, receptor) associated with eosinophils.

Illustrative eosinophils antigens of interest include, for example, CD35, CD44 and CD69. In various embodiments, the Clec9A binding agent comprises a targeting moiety that binds one or more of these eosinophil antigens.

In various embodiments, the multi-specific Clec9A binding agent of the invention comprises a targeting moiety having an antigen recognition domain that specifically binds to any appropriate antigen or receptor or cell surface markers known by the skilled artisan. In some embodiments, the antigen or cell surface marker is a tissue-specific marker. Illustrative tissue-specific markers include, but are not limited to, endothelial cell surface markers such as ACE, CD14, CD34, CDH5, ENG, ICAM2, MCAM, NOS3, PECAMI, PROCR, SELE, SELP, TEK, THBD, VCAMI, VWF; smooth muscle cell surface markers such as ACTA2, MYHIO, MYHI 1, MYH9, MYOCD; fibroblast (stromal) cell surface markers such as ALCAM, CD34, COLIAI, COL1A2, COL3A1, FAP, PH-4; epithelial cell surface markers such as CDID, K61RS2, KRTIO, KRT13, KRT17, KRT18, KRT19, KRT4, KRT5, KRT8, MUCI, TACSTDI; neovasculature markers such as CD13, TFNA, Alpha-v beta-3 ($\alpha_v\beta_3$), E-selectin; and adipocyte surface markers such as ADIPOQ, FABP4, and RETN. In various embodiments, the Clec9A binding agent comprises a targeting moiety that binds one or more of these antigens.

In various embodiments, the multi-specific Clec9A binding agent of the invention comprises a targeting moiety having an antigen recognition domain that specifically binds to a checkpoint marker expressed on a T cell, e.g. one or more of PD-1, CD28, CTLA4, ICOS, BTLA, KIR, LAG3, CD137, OX40, CD27, CD40L, TIM3, and A2aR.

In various embodiments, the multi-specific Clec9A binding agent of the invention comprises a targeting moiety having an antigen recognition domain that specifically binds to a checkpoint marker, e.g. one or more of PD-1/PD-L1 or PD-L2, CD28/CD80 or CD86, CTLA4/CD80 or CD86, ICOS/ICOSL or B7RP1, BTLA/HVEM, KIR, LAG3, CD137/CD137L, OX40/OX40L, CD27, CD40L, TIM3/Gal9, and A2aR.

By way of non-limiting example, in various embodiments, the present multispecific Clec9A binding agent comprises a targeting moiety directed against (i) CD8; (ii) a checkpoint marker expressed on a T cell, e.g. one or more of PD-1, CD28, CTLA4, ICOS, BTLA, KIR, LAG3, CD137, OX40, Cd27, CD40L, TIM3, and A2aR and/or (iii) a targeting moiety is directed against a tumor cell, along with any of the modified (e.g. mutant) signaling agents described herein.

In various embodiments, the present multi-specific Clec9A binding agent has one or more targeting moieties directed against PD-1. In some embodiments, the Clec9A binding agent has one or more targeting moieties which selectively bind a PD-1 polypeptide. In some embodiments, the Clec9A binding agent comprises one or more antibodies, antibody derivatives or formats, peptides or polypeptides, or fusion proteins that selectively bind a PD-1 polypeptide.

In various embodiments, the multi-specific Clec9A binding agent of the invention comprises a VHH against PD1 having a variable domain comprising at least one CDR1, CDR2, and/or CDR3 sequences.

In some embodiments, the PD1 CDR1 sequence is selected from SEQ ID NO: 649 to SEQ ID NO: 662.

In some embodiments, the PD1 CDR2 sequence is selected from SEQ ID NO: 663 to SEQ ID NO: 676.

In some embodiments, the PD1 CDR3 sequence is selected from SEQ ID NO: 677 to SEQ ID NO: 689.

In various exemplary embodiments, the PD1 targeting moiety comprises an amino acid sequence selected from the following sequences: 2PD23 (SEQ ID NO: 690) or 2PD26 (SEQ ID NO: 691) or 2PD90 (SEQ ID NO: 692) or 2PD106 (SEQ ID NO: 693) or 2PD16 (SEQ ID NO: 694) or 2PD71 (SEQ ID NO: 695) or 2PD152 (SEQ ID NO: 696) or 2PD12 (SEQ ID NO: 697) or 3PD55 (SEQ ID NO: 698) or 3PD82 (SEQ ID NO: 699) or 2PD8 (SEQ ID NO: 700) or 2PD27 (SEQ ID NO: 701) or 2PD82 (SEQ ID NO: 702) or 3PD36 (SEQ ID NO: 703).

In various exemplary embodiments, the PD1 targeting moiety comprises an amino acid sequence selected from any one of the above without the terminal histidine tag sequence (i.e., HHHHHH; SEQ ID NO: 324).

In some embodiments, the PD1 targeting moiety comprises an amino acid sequence selected from SEQ ID Nos: 690-703 (provided above) without the HA tag (i.e., YPYDVPDYGS; SEQ ID NO: 325).

In some embodiments, the PD1 targeting moiety comprises an amino acid sequence selected from SEQ ID Nos: 690-703 (provided above) without the AAA linker (i.e., AAA).

In some embodiments, the PD1 targeting moiety comprises an amino acid sequence selected from SEQ ID Nos: 690-703 (provided above) without the the AAA linker, HA tag, and terminal histidine tag sequence (i.e., AAAYPYDVPDYGSHHHHHH; SEQ ID NO: 326). In an embodiment, the targeting moiety comprises the anti-PD-1 antibody pembrolizumab (aka MK-3475, KEYTRUDA), or fragments thereof. Pembrolizumab and other humanized anti-PD-1 antibodies are disclosed in Hamid, et al. (2013) New England Journal of Medicine 369 (2): 134-44, U.S. Pat. No. 8,354,509, and WO 2009/114335, the entire disclosures of which are hereby incorporated by reference. In illustrative embodiments, pembrolizumab or an antigen-binding fragment thereof for use in the methods provided herein comprises a heavy chain comprising the amino acid sequence of SEQ ID NO: 704 and/or a light chain comprising the amino acid sequence of SEQ ID NO: 705.

In an embodiment, the targeting moiety comprises the anti-PD-1 antibody, nivolumab (aka BMS-936558, MDX-1106, ONO-4538, OPDIVO), orfragments thereof. Nivolumab (clone 5C4) and other human monoclonal antibodies that specifically bind to PD-1 are disclosed in U.S. Pat. No. 8,008,449 and WO 2006/121168, the entire disclosures of which are hereby incorporated by reference. In illustrative embodiments, nivolumab or an antigen-binding fragment thereof comprises a heavy chain comprising the amino acid sequence of SEQ ID NO: 706 and/or a light chain comprising the amino acid sequence of SEQ ID NO: 707.

In an embodiment, the targeting moiety comprises the anti-PD-1 antibody pidilizumab (aka CT-011, hBAT or hBAT-1), or fragments thereof. Pidilizumab and other humanized anti-PD-I monoclonal antibodies are disclosed in US 2008/0025980 and WO 2009/101611, the entire disclosures of which are hereby incorporated by reference. In illustrative embodiments, the anti-PD-1 antibody or an antigen-binding fragment thereof for use in the methods provided herein comprises a light chain variable regions comprising an amino acid sequence selected from SEQ ID NOS: 15-18 of US 2008/0025980: SEQ ID No: 15 of US 2008/0025980 (SEQ ID NO: 708); SEQ ID No: 16 of US 2008/0025980 (SEQ ID NO: 709); SEQ ID No: 17 of US 2008/0025980 (SEQ ID NO: 710); SEQ ID No: 18 of US 2008/0025980 (SEQ ID NO: 711); and/or a heavy chain comprising an amino acid sequence selected from SEQ ID NOS: 20-24 of US 2008/0025980: SEQ ID No: 20 of US 2008/0025980 (SEQ ID NO: 712); SEQ ID No: 21 of US 2008/0025980 (SEQ ID NO: 713); SEQ ID No: 22 of US 2008/0025980 (SEQ ID NO: 714); SEQ ID No: 23 of US 2008/0025980 (SEQ ID NO: 715); SEQ ID No: 24 of US 2008/0025980 (SEQ ID NO: 716).

In an embodiment, the targeting moiety comprises a light chain comprising SEQ ID NO:18 of US 2008/0025980 and a heavy chain comprising SEQ ID NO:22 of US 2008/0025980.

In an embodiment, the targeting moiety comprises AMP-514 (aka MEDI-0680).

In an embodiment, the targeting moiety comprises the PD-L2-Fc fusion protein AMP-224, which is disclosed in WO2010/027827 and WO 2011/066342, the entire disclosures of which are hereby incorporated by reference. In such an embodiment, the targeting moiety may include a targeting domain which comprises SEQ ID NO:4 of WO2010/027827 (SEQ ID NO: 717) and/or the B7-DC fusion protein which comprises SEQ ID NO:83 of WO2010/027827 (SEQ ID NO: 718).

In an embodiment, the targeting moiety comprises the peptide AUNP 12 or any of the other peptides disclosed in US 2011/0318373 or 8,907,053. For example, the targeting moiety may comprise AUNP 12 (i.e., Compound 8 or SEQ ID NO:49 of US 2011/0318373) which has the sequence of SEQ ID NO: 719:

SNTSESFK (SNTSESF) FRVTQLAPKAQIKE—NH2

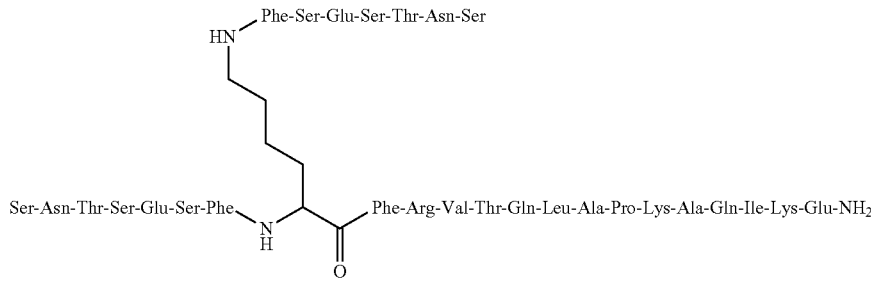

or:
SNTSESF—NH
|
SNTSESFKFRVTQLAPKAQIKE—NH$_2$.

In an embodiment, the targeting moiety comprises the anti-PD-1 antibody 1E3, or fragments thereof, as disclosed in US 2014/0044738, the entire disclosures of which are hereby incorporated by reference. In illustrative embodiments, 1E3 or an antigen-binding fragment thereof for use in the methods provided herein comprises a heavy chain variable region comprising the amino acid sequence of SEQ ID NO: 720; and/or a light chain variable region comprising the amino acid sequence of SEQ ID NO: 721.

In an embodiment, the targeting moiety comprises the anti-PD-1 antibody 1E8, or fragments thereof, as disclosed in US 2014/0044738, the entire disclosures of which are hereby incorporated by reference. In illustrative embodiments, 1E8 or an antigen-binding fragment thereof for use in the methods provided herein comprises a heavy chain variable region comprising the amino acid sequence of SEQ ID NO: 722; and/or alight chain variable region comprising the amino acid sequence of SEQ ID NO: 723.

In an embodiment, the targeting moiety comprises the anti-PD-1 antibody 1H3, or fragments thereof, as disclosed in US 2014/0044738, the entire disclosures of which are hereby incorporated by reference. In illustrative embodiments, 1H3 or an antigen-binding fragment thereof for use in the methods provided herein comprises a heavy chain variable region comprising the amino acid sequence of SEQ ID NO: 724; and/or light chain variable region comprising the amino acid sequence of SEQ ID NO: 725.

In an embodiment, the targeting moiety comprises a VHH directed against PD-1 as disclosed, for example, in U.S. Pat. No. 8,907,065 and WO 2008/071447, the entire disclosures of which are hereby incorporated by reference. In illustrative embodiments, the VHHs against PD-1 comprise SEQ ID NOS: 347-351 of U.S. Pat. No. 8,907,065: SEQ ID No: 347 of U.S. Pat. No. 8,907,065 (SEQ ID NO: 726); SEQ ID No: 348 of U.S. Pat. No. 8,907,065 (SEQ ID NO: 727); SEQ ID No: 349 of U.S. Pat. No. 8,907,065 (SEQ ID NO: 728); SEQ ID No: 350 of U.S. Pat. No. 8,907,065 (SEQ ID NO: 729); SEQ ID No: 351 of U.S. Pat. No. 8,907,065 (SEQ ID NO: 730).

In an embodiment, the targeting moiety comprises any one of the anti-PD-1 antibodies, or fragments thereof, as disclosed in US2011/0271358 and WO2010/036959, the entire contents of which are hereby incorporated by reference. In illustrative embodiments, the antibody or an antigen-binding fragment thereof for use in the methods provided herein comprises a heavy chain comprising an amino acid sequence selected from SEQ ID NOS: 25-29 of US2011/0271358: SEQ ID No: 25 of US2011/0271358 (SEQ ID NO: 731); SEQ ID No: 26 of US2011/0271358 (SEQ ID NO: 732); SEQ ID No: 27 of US2011/0271358 (SEQ ID NO: 733); SEQ ID No: 28 of US2011/0271358 (SEQ ID NO: 734); SEQ ID No: 29 of US2011/0271358 (SEQ ID NO: 735); and/or a light chain comprising an amino acid sequence selected from SEQ ID NOS: 30-33 of US2011/0271358: SEQ ID No: 30 of US2011/0271358 (SEQ ID NO: 736); SEQ ID No: 31 of US2011/0271358 (SEQ ID NO: 737); SEQ ID No: 32 of US2011/0271358 (SEQ ID NO: 738); SEQ ID No: 33 of US2011/0271358 (SEQ ID NO: 739).

In various embodiments, the present multi-specific Clec9A binding agent comprises one or more antibodies directed against PD-1, or antibody fragments thereof, selected from TSR-042 (Tesaro, Inc.), REGN2810 (Regeneron Pharmaceuticals, Inc.), PDR001 (Novartis Pharmaceuticals), and BGB-A317 (BeiGene Ltd.) In various embodiments, the present multi-specific Clec9A binding agent has one or more targeting moieties directed against PD-L1. In some embodiments, the Clec9A binding agent has one or more targeting moieties which selectively bind a PD-L1 polypeptide. In some embodiments, the Clec9A binding agent comprises one or more antibodies, antibody derivatives or formats, peptides or polypeptides, or fusion proteins that selectively bind a PD-L1 polypeptide.

In various embodiments, the multi-specific Clec9A binding agent of the invention comprises a VHH against PD-L1 having a variable domain comprising at least one CDR1, CDR2, and/or CDR3 sequences.

In some embodiments, the PD-L1 CDR1 sequence is selected from SEQ ID NO: 740 to SEQ ID NO: 770.

In some embodiments, the PD-L1 CDR2 sequence is selected from SEQ ID NO: 771 to SEQ ID NO: 801.

In some embodiments, the PD-L1 CDR3 sequence is selected from SEQ ID NO: 802 to SEQ ID NO: 832.

In various exemplary embodiments, the PD-L1 targeting moiety comprises an amino acid sequence selected from the following sequences: 2LIG2 (SEQ ID NO: 833) or 2LIG3 (SEQ ID NO: 834) or 2LIG16 (SEQ ID NO: 835) or 2LIG22 (SEQ ID NO: 836) or 2LIG27 (SEQ ID NO: 837) or 2LIG29 (SEQ ID NO: 838) or 2LIG30 (SEQ ID NO: 839) or 2LIG34 (SEQ ID NO: 840) or 2LIG35 (SEQ ID NO: 841) or 2LIG48 (SEQ ID NO: 842) or 2LIG65 (SEQ ID NO: 843) or 2LIG85 (SEQ ID NO: 844) or 2LIG86 (SEQ ID NO: 845) or 2LIG89

(SEQ ID NO: 846) or 2LIG97 (SEQ ID NO: 847) or 2LIG99 (SEQ ID NO: 848) or 2LIG109 (SEQ ID NO: 849) or 2LIG127 (SEQ ID NO: 850) or 2LIG139 (SEQ ID NO: 851) or 2LIG176 (SEQ ID NO: 852) or 2LIG189 (SEQ ID NO: 853) or 3LIG3 (SEQ ID NO: 854) or 3LIG7 (SEQ ID NO: 855) or 3LIG8 (SEQ ID NO: 856) or 3LIG9 (SEQ ID NO: 857) or 3LIG18 (SEQ ID NO: 858) or 3LIG20 (SEQ ID NO: 859) or 3LIG28 (SEQ ID NO: 860) or 3LIG29 (SEQ ID NO: 861) or 3LIG30 (SEQ ID NO: 862) or 3LIG33 (SEQ ID NO: 863).

In various exemplary embodiments, the PD-L1 targeting moiety comprises an amino acid sequence selected from any one of the above sequences without the terminal histidine tag sequence (i.e., HHHHHH; SEQ ID NO: 324).

In some embodiments, the PD-L1 targeting moiety comprises an amino acid sequence selected from SEQ ID Nos: 833-863 (provided above) without the HA tag (i.e., YPYDVPDYGS; SEQ ID NO: 325).

In some embodiments, the PD-L1 targeting moiety comprises an amino acid sequence selected from SEQ ID Nos: 833-863 (provided above) without the AAA linker (i.e., AAA).

In some embodiments, the PD-L1 targeting moiety comprises an amino acid sequence selected from SEQ ID Nos: 833-863 (provided above) without the the AAA linker, HA tag, and terminal histidine tag sequence (i.e., AAAYPYDVPDYGSHHHHHH; SEQ ID NO: 326). In an embodiment, the targeting moiety comprises the anti-PD-L1 antibody MEDI4736 (aka durvalumab), or fragments thereof. MEDI4736 is selective for PD-L1 and blocks the binding of PD-L1 to the PD-1 and CD80 receptors. MEDI4736 and antigen-binding fragments thereof for use in the methods provided herein comprises a heavy chain and a light chain or a heavy chain variable region and a light chain variable region. The sequence of MEDI4736 is disclosed in WO/2016/06272, the entire contents of which are hereby incorporated by reference. In illustrative embodiments, MEDI4736 or an antigen-binding fragment thereof for use in the methods provided herein comprises a heavy chain comprising the amino acid sequence of (SEQ ID NO: 864); and/or a light chain comprising the amino acid sequence of SEQ ID NO: 865.

In illustrative embodiments, the MEDI4736 or an antigen-binding fragment thereof for use in the methods provided herein comprises a heavy chain variable region comprising the amino acid sequence of SEQ ID NO:4 of WO/2016/06272 (SEQ ID NO: 866); and/or a light chain variable region comprising the amino acid sequence of SEQ ID NO:3 of WO/2016/06272 (SEQ ID NO: 867).

In an embodiment, the targeting moiety comprises the anti-PD-L1 antibody atezolizumab (aka MPDL3280A, RG7446), or fragments thereof. In illustrative embodiments, atezolizumab or an antigen-binding fragment thereof for use in the methods provided herein comprises a heavy chain comprising the amino acid sequence of: SEQ ID NO: 868; and/or a light chain comprising the amino acid sequence of: SEQ ID NO: 869.

In an embodiment, the targeting moiety comprises the anti-PD-L1 antibody avelumab (aka MSB0010718C), or fragments thereof. In illustrative embodiments, avelumab or an antigen-binding fragment thereof for use in the methods provided herein comprises a heavy chain comprising the amino acid sequence of SEQ ID NO: 870; and/or a light chain comprising the amino acid sequence of SEQ ID NO: 871.

In an embodiment, the targeting moiety comprises the anti-PD-L1 antibody BMS-936559 (aka 12A4, MDX-1105), or fragments thereof, as disclosed in US 2013/0309250 and WO2007/005874, the entire disclosures of which are hereby incorporated by reference. In illustrative embodiments, BMS-936559 or an antigen-binding fragment thereof for use in the methods provided herein comprises a heavy chain variable region comprising the amino acid sequence of SEQ ID NO: 872; and/or a light chain variable region comprising the amino acid sequence of SEQ ID NO: 873.

In an embodiment, the targeting moiety comprises the anti-PD-L1 antibody 3G10, or fragments thereof, as disclosed in US 2013/0309250 and WO2007/005874, the entire disclosures of which are hereby incorporated by reference. In illustrative embodiments, 3G10 or an antigen-binding fragment thereof for use in the methods provided herein comprises a heavy chain variable region comprising the amino acid sequence of SEQ ID NO: 874; and/or a light chain variable region comprising the amino acid sequence of SEQ ID NO: 875.

In an embodiment, the targeting moiety comprises the anti-PD-L1 antibody 10A5, or fragments thereof, as disclosed in US 2013/0309250 and WO2007/005874, the entire disclosures of which are hereby incorporated by reference. In illustrative embodiments, 10A5 or an antigen-binding fragment thereof for use in the methods provided herein comprises a heavy chain variable region comprising the amino acid sequence of SEQ ID NO: 876; and/or a light chain variable region comprising the amino acid sequence of SEQ ID NO: 877.

In an embodiment, the targeting moiety comprises the anti-PD-L1 antibody 5F8, or fragments thereof, as disclosed in US 2013/0309250 and WO2007/005874, the entire disclosures of which are hereby incorporated by reference. In illustrative embodiments, 5F8 or an antigen-binding fragment thereof for use in the methods provided herein comprises a heavy chain variable region comprising the amino acid sequence of SEQ ID NO: 878; and/or a light chain variable region comprising the amino acid sequence of SEQ ID NO: 879.

In an embodiment, the targeting moiety comprises the anti-PD-L1 antibody 10H10, or fragments thereof, as disclosed in US 2013/0309250 and WO2007/005874, the entire disclosures of which are hereby incorporated by reference. In illustrative embodiments, 10H10 or an antigen-binding fragment thereof for use in the methods provided herein comprises a heavy chain variable region comprising the amino acid sequence of SEQ ID NO: 880; and/or a light chain variable region comprising the amino acid sequence of SEQ ID NO: 881.

In an embodiment, the targeting moiety comprises the anti-PD-L1 antibody 1B12, or fragments thereof, as disclosed in US 2013/0309250 and WO2007/005874, the entire disclosures of which are hereby incorporated by reference. In illustrative embodiments, 1B12 or an antigen-binding fragment thereof for use in the methods provided herein comprises a heavy chain variable region comprising the amino acid sequence of SEQ ID NO: 882; and/or a light chain variable region comprising the amino acid sequence of SEQ ID NO: 883.

In an embodiment, the targeting moiety comprises the anti-PD-L1 antibody 7H1, or fragments thereof, as disclosed in US 2013/0309250 and WO2007/005874, the entire disclosures of which are hereby incorporated by reference. In illustrative embodiments, 7H1 or an antigen-binding fragment thereof for use in the methods provided herein comprises a heavy chain variable region comprising the amino acid sequence of SEQ ID NO: 884; and/or a light chain variable region comprising the amino acid sequence of SEQ ID NO: 885.

In an embodiment, the targeting moiety comprises the anti-PD-L1 antibody 11E6, or fragments thereof, as disclosed in US 2013/0309250 and WO2007/005874, the entire disclosures of which are hereby incorporated by reference. In illustrative embodiments, 11E6 or an antigen-binding fragment thereof for use in the methods provided herein comprises a heavy chain variable region comprising the amino acid sequence of SEQ ID NO: 886; and/or a light chain variable region comprising the amino acid sequence of SEQ ID NO: 887.

In an embodiment, the targeting moiety comprises the anti-PD-L1 antibody 12B7, or fragments thereof, as disclosed in US 2013/0309250 and WO2007/005874, the entire disclosures of which are hereby incorporated by reference. In illustrative embodiments, 12B7 or an antigen-binding fragment thereof for use in the methods provided herein comprises a heavy chain variable region comprising the amino acid sequence of SEQ ID NO: 888; and/or a light chain variable region comprising the amino acid sequence of SEQ ID NO: 889.

In an embodiment, the targeting moiety comprises the anti-PD-L1 antibody 13G4, or fragments thereof, as disclosed in US 2013/0309250 and WO2007/005874, the entire disclosures of which are hereby incorporated by reference. In illustrative embodiments, 13G4 or an antigen-binding fragment thereof for use in the methods provided herein comprises a heavy chain variable region comprising the amino acid sequence of SEQ ID NO: 890; and/or a light chain variable region comprising the amino acid sequence of SEQ ID NO: 891.

In an embodiment, the targeting moiety comprises the anti-PD-L1 antibody 1E12, or fragments thereof, as disclosed in US 2014/0044738, the entire disclosures of which are hereby incorporated by reference. In illustrative embodiments, 1E12 or an antigen-binding fragment thereof for use in the methods provided herein comprises a heavy chain variable region comprising the amino acid sequence of SEQ ID NO: 892; and/or a light chain variable region comprising the amino acid sequence of SEQ ID NO: 893.

In an embodiment, the targeting moiety comprises the anti-PD-L1 antibody 1F4, or fragments thereof, as disclosed in US 2014/0044738, the entire disclosures of which are hereby incorporated by reference. In illustrative embodiments, 1F4 or an antigen-binding fragment thereof for use in the methods provided herein comprises a heavy chain variable region comprising the amino acid sequence of SEQ ID NO: 894; and/or alight chain variable region comprising the amino acid sequence of SEQ ID NO: 895.

In an embodiment, the targeting moiety comprises the anti-PD-L1 antibody 2G11, or fragments thereof, as disclosed in US 2014/0044738, the entire disclosures of which are hereby incorporated by reference. In illustrative embodiments, 2G11 or an antigen-binding fragment thereof for use in the methods provided herein comprises a heavy chain variable region comprising the amino acid sequence of SEQ ID NO: 896; and/or alight chain variable region comprising the amino acid sequence of SEQ ID NO: 897.

In an embodiment, the targeting moiety comprises the anti-PD-L1 antibody 3B6, or fragments thereof, as disclosed in US 2014/0044738, the entire disclosures of which are hereby incorporated by reference. In illustrative embodiments, 3B6 or an antigen-binding fragment thereof for use in the methods provided herein comprises a heavy chain variable region comprising the amino acid sequence of SEQ ID NO: 898; and/or a light chain variable region comprising the amino acid sequence of SEQ ID NO: 899.

In an embodiment, the targeting moiety comprises the anti-PD-L1 antibody 3D10, or fragments thereof, as disclosed in US 2014/0044738 and WO2012/145493, the entire disclosures of which are hereby incorporated by reference. In illustrative embodiments, 3D10 or an antigen-binding fragment thereof for use in the methods provided herein comprises a heavy chain variable region comprising the amino acid sequence of SEQ ID NO: 900); and/or a light chain variable region comprising the amino acid sequence of SEQ ID NO: 901.

In an embodiment, the targeting moiety comprises any one of the anti-PD-L1 antibodies disclosed in US2011/0271358 and WO2010/036959, the entire contents of which are hereby incorporated by reference. In illustrative embodiments, the antibody or an antigen-binding fragment thereof for use in the methods provided herein comprises a heavy chain comprising an amino acid sequence selected from SEQ ID NO: 34-38 of US2011/0271358: SEQ ID NO: 34 of US2011/0271358 (SEQ ID NO: 902); SEQ ID NO: 35 of US2011/0271358 (SEQ ID NO: 903); SEQ ID NO: 36 of US2011/0271358 (SEQ ID NO: 904); SEQ ID NO: 37 of US2011/0271358 (SEQ ID NO: 905); SEQ ID NO: 38 of US2011/0271358 (SEQ ID NO: 906); and/or a light chain comprising an amino acid sequence selected from SEQ ID NO: 39-42 of US2011/0271358: SEQ ID NO: 39 of US2011/0271358 (SEQ ID NO: 907); SEQ ID NO: 40 of US2011/0271358 (SEQ ID NO: 908); SEQ ID NO: 41 of US2011/0271358 (SEQ ID NO: 909); SEQ ID NO: 42 of US2011/0271358 (SEQ ID NO: 910).

In an embodiment, the targeting moiety comprises the anti-PD-L1 antibody 2.7A4, or fragments thereof, as disclosed in WO 2011/066389, U.S. Pat. No. 8,779,108, and US2014/0356353, the entire disclosures of which are hereby incorporated by reference. In illustrative embodiments, 2.7A4 or an antigen-binding fragment thereof for use in the methods provided herein comprises a heavy chain variable region comprising the amino acid sequence of: SEQ SEQ ID NO: 2 of WO 2011/066389 (SEQ ID NO: 911); and/or a light chain variable region comprising the amino acid sequence of: SEQ ID NO: 7 of WO 2011/066389 (SEQ ID NO: 912).

In an embodiment, the targeting moiety comprises the anti-PD-L1 antibody 2.9D10, or fragments thereof, as disclosed in WO 2011/066389, U.S. Pat. No. 8,779,108, and US2014/0356353, the entire disclosures of which are hereby incorporated by reference. In illustrative embodiments, 2.9D10 or an antigen-binding fragment thereof for use in the methods provided herein comprises a heavy chain variable region comprising the amino acid sequence of: SEQ ID NO: 12 of WO 2011/066389 (SEQ ID NO: 913); and/or a light chain variable region comprising the amino acid sequence of: SEQ ID NO: 17 of WO 2011/066389 (SEQ ID NO: 914).

In an embodiment, the targeting moiety comprises the anti-PD-L1 antibody 2.14H9, or fragments thereof, as disclosed in WO 2011/066389, U.S. Pat. No. 8,779,108, and US2014/0356353, the entire disclosures of which are hereby incorporated by reference. In illustrative embodiments, 2.14H9 or an antigen-binding fragment thereof for use in the methods provided herein comprises a heavy chain variable region comprising the amino acid sequence of: SEQ ID NO: 22 of WO 2011/066389 (SEQ ID NO: 915); and/or a light chain variable region comprising the amino acid sequence of: SEQ ID NO: 27 of WO 2011/066389 (SEQ ID NO: 916).

In an embodiment, the targeting moiety comprises the anti-PD-L1 antibody 2.20A8, or fragments thereof, as disclosed in WO 2011/066389, U.S. Pat. No. 8,779,108, and US2014/0356353, the entire disclosures of which are hereby incorporated by reference. In illustrative embodiments, 2.20A8 or an antigen-binding fragment thereof for use in the methods provided herein comprises a heavy chain variable region comprising the amino acid sequence of: SEQ ID NO: 32 of WO 2011/066389 (SEQ ID NO: 917); and/or a light chain variable region comprising the amino acid sequence of: SEQ ID NO: 37 of WO 2011/066389 (SEQ ID NO: 918).

In an embodiment, the targeting moiety comprises the anti-PD-L1 antibody 3.15G8, or fragments thereof, as disclosed in WO 2011/066389, U.S. Pat. No. 8,779,108, and US2014/0356353, the entire disclosures of which are hereby incorporated by reference. In illustrative embodiments, 3.15G8 or an antigen-binding fragment thereof for use in the methods provided herein comprises a heavy chain variable region comprising the amino acid sequence of: SEQ ID NO: 42 of WO 2011/066389 (SEQ ID NO: 919); and/or a light chain variable region comprising the amino acid sequence of: SEQ ID NO: 47 of WO 2011/066389 (SEQ ID NO: 920).

In an embodiment, the targeting moiety comprises the anti-PD-L1 antibody 3.18G1, or fragments thereof, as disclosed in WO 2011/066389, U.S. Pat. No. 8,779,108, and US2014/0356353, the entire disclosures of which are hereby incorporated by reference. In illustrative embodiments, 3.18G1 or an antigen-binding fragment thereof for use in the methods provided herein comprises a heavy chain variable region comprising the amino acid sequence of: SEQ ID NO: 52 of WO 2011/066389 (SEQ ID NO: 921); and/or a light chain variable region comprising the amino acid sequence of; SEQ ID NO: 57 of WO 2011/066389 (SEQ ID NO: 922).

In an embodiment, the targeting moiety comprises the anti-PD-L1 antibody 2.7A40PT, or fragments thereof, as disclosed in WO 2011/066389, U.S. Pat. No. 8,779,108, and US2014/0356353, and US2014/0356353, the entire disclosures of which are hereby incorporated by reference. In illustrative embodiments, 2.7A4OPT or an antigen-binding fragment thereof for use in the methods provided herein comprises a heavy chain variable region comprising the amino acid sequence of: SEQ ID NO: 62 of WO 2011/066389 (SEQ ID NO: 923); and/or a light chain variable region comprising the amino acid sequence of: SEQ ID NO: 67 of WO 2011/066389 (SEQ ID NO: 924).

In an embodiment, the targeting moiety comprises the anti-PD-L1 antibody 2.14H90PT, or fragments thereof, as disclosed in WO 2011/066389, U.S. Pat. No. 8,779,108, and US2014/0356353, the entire disclosures of which are hereby incorporated by reference. In illustrative embodiments, 2.14H90PT or an antigen-binding fragment thereof for use in the methods provided herein comprises a heavy chain variable region comprising the amino acid sequence of: SEQ ID NO: 72 of WO 2011/066389 (SEQ ID NO: 925); and/or a light chain variable region comprising the amino acid sequence of: SEQ ID NO: 77 of WO 2011/066389 (SEQ ID NO: 926).

In an embodiment, the targeting moiety comprises any one of the anti-PD-L1 antibodies disclosed in WO2016/061142, the entire contents of which are hereby incorporated by reference. In illustrative embodiments, the antibody or an antigen-binding fragment thereof for use in the methods provided herein comprises a heavy chain comprising an amino acid sequence selected from SEQ ID NO: 18, 30, 38, 46, 50, 54, 62, 70, and 78 of WO2016/061142: SEQ ID NO: 18 of WO2016/061142 (SEQ ID NO: 927); SEQ ID NO: 30 of WO2016/061142 (SEQ ID NO: 928); SEQ ID NO: 38 of WO2016/061142 (SEQ ID NO: 929); SEQ ID NO: 46 of WO2016/061142 (SEQ ID NO: 930); SEQ ID NO: 50 of WO2016/061142 (SEQ ID NO: 931); SEQ ID NO: 54 of WO2016/061142 (SEQ ID NO: 932); SEQ ID NO: 62 of WO2016/061142 (SEQ ID NO: 933); SEQ ID NO: 70 of WO2016/061142 (SEQ ID NO: 934); SEQ ID NO: 78 of WO2016/061142 (SEQ ID NO: 935); and/or a light chain comprising an amino acid sequence selected from SEQ ID NO: 22, 26, 34, 42, 58, 66, 74, 82, and 86 of WO2016/061142: SEQ ID NO: 22 of WO2016/061142 (SEQ ID NO: 936); SEQ ID NO: 26 of WO2016/061142 (SEQ ID NO: 937); SEQ ID NO: 34 of WO2016/061142 (SEQ ID NO: 938); SEQ ID NO: 42 of WO2016/061142 (SEQ ID NO: 939); SEQ ID NO: 58 of WO2016/061142 (SEQ ID NO: 940); SEQ ID NO: 66 of WO2016/061142 (SEQ ID NO: 941); SEQ ID NO: 74 of WO2016/061142 (SEQ ID NO: 942); SEQ ID NO: 82 of WO2016/061142 (SEQ ID NO: 943); SEQ ID NO: 86 of WO2016/061142 (SEQ ID NO: 944).

In an embodiment, the targeting moiety comprises any one of the anti-PD-L1 antibodies disclosed in WO2016/022630, the entire contents of which are hereby incorporated by reference. In illustrative embodiments, the antibody or an antigen-binding fragment thereof for use in the methods provided herein comprises a heavy chain comprising an amino acid sequence selected from SEQ ID NO: 2, 6, 10, 14, 18, 22, 26, 30, 34, 38, 42, and 46 of WO2016/022630: SEQ ID NO: 2 of WO2016/022630 (SEQ ID NO: 945); SEQ ID NO: 6 of WO2016/022630 (SEQ ID NO: 946); SEQ ID NO: 10 of WO2016/022630 (SEQ ID NO: 947); SEQ ID NO: 14 of WO2016/022630 (SEQ ID NO: 948); SEQ ID NO: 18 of WO2016/022630 (SEQ ID NO: 949); SEQ ID NO: 22 of WO2016/022630 (SEQ ID NO: 950); SEQ ID NO: 26 of WO2016/022630 (SEQ ID NO: 951); SEQ ID NO: 30 of WO2016/022630 (SEQ ID NO: 952); SEQ ID NO: 34 of WO2016/022630 (SEQ ID NO: 953); SEQ ID NO: 38 of WO2016/022630 (SEQ ID NO: 954); SEQ ID NO: 42 of WO2016/022630 (SEQ ID NO: 955); SEQ ID NO: 46 of WO2016/022630 (SEQ ID NO: 956); and/or a light chain comprising an amino acid sequence selected from SEQ ID NO: 4, 8, 12, 16, 20, 24, 28, 32, 36, 40, 44, and 48 of WO2016/022630: SEQ ID NO: 4 of WO2016/022630 (SEQ ID NO: 957); SEQ ID NO: 8 of WO2016/022630 (SEQ ID NO: 958); SEQ ID NO: 12 of WO2016/022630 (SEQ ID NO: 959); SEQ ID NO: 16 of WO2016/022630 (SEQ ID NO: 960); SEQ ID NO: 20 of WO2016/022630 (SEQ ID NO: 961); SEQ ID NO: 24 of WO2016/022630 (SEQ ID NO: 962); SEQ ID NO: 28 of WO2016/022630 (SEQ ID NO: 963); SEQ ID NO: 32 of WO2016/022630 (SEQ ID NO: 964); SEQ ID NO: 36 of WO2016/022630 (SEQ ID NO: 965); SEQ ID NO: 40 of WO2016/022630 (SEQ ID NO: 966); SEQ ID NO: 44 of WO2016/022630 (SEQ ID NO: 967); SEQ ID NO: 48 of WO2016/022630 (SEQ ID NO: 968).

In an embodiment, the targeting moiety comprises any one of the anti-PD-L1 antibodies disclosed in WO2015/112900, the entire contents of which are hereby incorporated by reference. In illustrative embodiments, the antibody or an antigen-binding fragment thereof for use in the methods provided herein comprises a heavy chain comprising an amino acid sequence selected from SEQ ID NO: 38, 50, 82, and 86 of WO 2015/112900: SEQ ID NO: 38 of WO2015/112900 (SEQ ID NO: 969); SEQ ID NO: 50 of WO 2015/112900 (SEQ ID NO: 970); SEQ ID NO: 82 of WO 2015/112900 (SEQ ID NO: 971); SEQ ID NO: 86 of WO 2015/112900 (SEQ ID NO: 972); and/or a light chain comprising an amino acid sequence selected from SEQ ID NO: 42, 46, 54, 58, 62, 66, 70, 74, and 78 of WO 2015/112900: SEQ ID NO: 42 of WO2015/112900 (SEQ ID NO:

973); SEQ ID NO: 46 of WO 2015/112900 (SEQ ID NO: 974); SEQ ID NO: 54 of WO 2015/112900 (SEQ ID NO: 975); SEQ ID NO: 58 of WO 2015/112900 (SEQ ID NO: 976); SEQ ID NO: 62 of WO 2015/112900 (SEQ ID NO: 977); SEQ ID NO: 66 of WO 2015/112900 (SEQ ID NO: 978); SEQ ID NO: 70 of WO 2015/112900 (SEQ ID NO: 979); SEQ ID NO: 74 of WO 2015/112900 (SEQ ID NO: 980); SEQ ID NO: 78 of WO 2015/112900 (SEQ ID NO: 981).

In an embodiment, the targeting moiety comprises any one of the anti-PD-L1 antibodies disclosed in WO 2010/077634 and U.S. Pat. No. 8,217,149, the entire disclosures of which are hereby incorporated by reference. In illustrative embodiments, the anti-PD-L1 antibody or an antigen-binding fragment thereof for use in the methods provided herein comprises a heavy chain region comprising the amino acid sequence of: SEQ ID NO: 20 of WO 2010/077634 (SEQ ID NO: 982); and/or a light chain variable region comprising the amino acid sequence of: SEQ ID NO: 21 of WO 2010/077634 (SEQ ID NO: 983).

In an embodiment, the targeting moiety comprises any one of the anti-PD-L1 antibodies obtainable from the hybridoma accessible under CNCM deposit numbers CNCM I-4122, CNCM I-4080 and CNCM I-4081 as disclosed in US 20120039906, the entire disclosures of which are hereby incorporated by reference.

In an embodiment, the targeting moiety comprises a VHH directed against PD-L1 as disclosed, for example, in U.S. Pat. No. 8,907,065 and WO 2008/071447, the entire disclosures of which are hereby incorporated by reference. In illustrative embodiments, the VHHs against PD-L1 comprise SEQ ID NO: 394-399 of U.S. Pat. No. 8,907,065: SEQ ID NO: 394 of U.S. Pat. No. 8,907,065 (SEQ ID NO: 984); SEQ ID NO: 395 of U.S. Pat. No. 8,907,065 (SEQ ID NO: 985); SEQ ID NO: 396 of U.S. Pat. No. 8,907,065 (SEQ ID NO: 986); SEQ ID NO: 397 of U.S. Pat. No. 8,907,065 (SEQ ID NO: 987); SEQ ID NO: 398 of U.S. Pat. No. 8,907,065 (SEQ ID NO: 988); SEQ ID NO: 399 of U.S. Pat. No. 8,907,065 (SEQ ID NO: 989) In various embodiments, the present multi-specific Clec9A binding agent has one or more targeting moieties directed against PD-L2. In some embodiments, the Clec9A binding agent has one or more targeting moieties which selectively bind a PD-L2 polypeptide. In some embodiments, the Clec9A binding agent comprises one or more antibodies, antibody derivatives or formats, peptides or polypeptides, or fusion proteins that selectively bind a PD-L2 polypeptide.

In an embodiment, the targeting moiety comprises a VHH directed against PD-L2 as disclosed, for example, in U.S. Pat. No. 8,907,065 and WO 2008/071447, the entire disclosures of which are hereby incorporated by reference. In illustrative embodiments, the VHHs against PD-1 comprise SEQ ID NO: 449-455 of U.S. Pat. No. 8,907,065: SEQ ID NO: 449 of U.S. Pat. No. 8,907,065 (SEQ ID NO: 990); SEQ ID NO: 450 of U.S. Pat. No. 8,907,065 (SEQ ID NO: 991); SEQ ID NO: 451 of U.S. Pat. No. 8,907,065 (SEQ ID NO: 992); SEQ ID NO: 452 of U.S. Pat. No. 8,907,065 (SEQ ID NO: 993); SEQ ID NO: 453 of U.S. Pat. No. 8,907,065 (SEQ ID NO: 994); SEQ ID NO: 454 of U.S. Pat. No. 8,907,065 (SEQ ID NO: 995); SEQ ID NO: 455 of U.S. Pat. No. 8,907,065 (SEQ ID NO: 996).

In an embodiment, the targeting moiety comprises any one of the anti-PD-L2 antibodies disclosed in US2011/0271358 and WO2010/036959, the entire contents of which are hereby incorporated by reference. In illustrative embodiments, the antibody or an antigen-binding fragment thereof for use in the methods provided herein comprises a heavy chain comprising an amino acid sequence selected from SEQ ID NO: 43-47 of US2011/0271358: SEQ ID NO: 43 of US2011/0271358 (SEQ ID NO: 997): SEQ ID NO: 44 of US2011/0271358 (SEQ ID NO: 998); SEQ ID NO: 45 of US2011/0271358 (SEQ ID NO: 999); SEQ ID NO: 46 of US2011/0271358 (SEQ ID NO: 1000); SEQ ID NO: 47 of US2011/0271358 (SEQ ID NO: 1001); and/or a light chain comprising an amino acid sequence selected from SEQ ID NO: 48-51 of US2011/0271358: SEQ ID NO: 48 of US2011/0271358 (SEQ ID NO: 1002); SEQ ID NO: 49 of US2011/0271358 (SEQ ID NO: 1003); SEQ ID NO: 50 of US2011/0271358 (SEQ ID NO: 1004); SEQ ID NO: 51 of US2011/0271358 (SEQ ID NO: 1005).

In various embodiments, the targeting moieties of the invention may comprise a sequence that targets PD-1, PD-L1, and/or PD-L2 which is at least about 60%, at least about 61%, at least about 62%, at least about 63%, at least about 64%, at least about 65%, at least about 66%, at least about 67%, at least about 68%, at least about 69%, at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or 100% identical to any of the sequences disclosed herein (e.g. about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, about 99% or about 100% sequence identity with any of the sequences disclosed herein).

In various embodiments, the targeting moieties of the invention may comprise any combination of heavy chain, light chain, heavy chain variable region, light chain variable region, complementarity determining region (CDR), and framework region sequences that target PD-1, PD-L1, and/or PD-L2 as disclosed herein.

Additional antibodies, antibody derivatives or formats, peptides or polypeptides, or fusion proteins that selectively bind or target PD-1, PD-L1 and/or PD-L2 are disclosed in WO 2011/066389, US 2008/0025980, US 2013/0034559, U.S. Pat. No. 8,779,108, US 2014/0356353, U.S. Pat. No. 8,609,089, US 2010/028330, US 2012/0114649, WO 2010/027827, WO 2011,/066342, U.S. Pat. No. 8,907,065, WO 2016/062722, WO 2009/101611, WO2010/027827, WO 2011/066342, WO 2007/005874, WO 2001/014556, US2011/0271358, WO 2010/036959, WO 2010/077634, U.S. Pat. No. 8,217,149, US 2012/0039906, WO 2012/145493, US 2011/0318373, U.S. Pat. No. 8,779,108, US 20140044738, WO 2009/089149, WO 2007/00587, WO 2016061142, WO 2016,02263, WO 2010/077634, and WO 2015/112900, the entire disclosures of which are hereby incorporated by reference.

In various embodiments, the multispecific Clec9A binding agent of the present technology comprises a targeting moiety against signal regulatory protein α-1 (SIRP1α).

SIRP1α (also known as SIRPα) belongs to a family of cell immune receptors encompassing inhibitory (SIRPα), activating (SIRPβ), nonsignaling (SIRPγ) and soluble (SIRPδ) members. SIRP1α is expressed primarily on myeloid cells, including macrophages, granulocytes, myeloid dendritic cells (DCs), mast cells, and their precursors, including hematopoietic stem cells. SIRP1α acts as an inhibitory receptor that interacts with a broadly expressed transmembrane glycoprotein CD47 to regulate phagocytosis. In particular, the binding of SIRP1α on macrophages by CD47 expressed on target cells, generates an inhibitory signal that negatively regulates phagocytosis of the target cell.

In various embodiments, the SIRP1α targeting moiety is a targeting moiety that specifically recognizes and binds SIRP1α on macrophages.

In various embodiments, the SIRP1α targeting moiety is a targeting moiety that specifically recognizes and binds SIRP1α on monocytes.

In various embodiments, the SIRP1α targeting moiety is a targeting moiety that specifically recognizes and binds SIRP1α on TAMs (Tumor Associated Macrophages).

In various embodiments, the SIRP1α targeting moiety is a targeting moiety that specifically recognizes and binds SIRP1α on dendritic cells, including without limitation cDC2 and pDC.

In various embodiments, the SIRP1α targeting moiety comprises a targeting moiety having a recognition domain that recognizes SIRP1α. In an embodiment, the recognition domain recognizes one or more linear epitopes present on SIRP1α. As used herein, a linear epitope refers to any continuous sequence of amino acids present on SIRP1α.

In another embodiment, the recognition domain recognizes one or more conformational epitopes present on SIRP1α. As used herein, a conformation epitope refers to one or more sections of amino acids (which may be discontinuous) which form a three-dimensional surface with features and/or shapes and/or tertiary structures capable of being recognized by an antigen recognition domain.

In some embodiments, the SIRP1α targeting moiety may bind to the full-length and/or mature forms and/or isoforms and/or splice variants and/or fragments and/or any other naturally occurring or synthetic analogs, variants, or mutants of SIRP1α. In an embodiment, the SIRP1α is human SIRP1α. In various embodiments, the SIRP1α targeting moiety may bind to any forms of the human SIRP1α, including monomeric, dimeric, heterodimeric, multimeric and associated forms. In an embodiment, the SIRP1α targeting moiety binds to the monomeric form of SIRP1α. In another embodiment, the SIRP1α targeting moiety binds to a dimeric form of SIRP1α.

In an embodiment, the SIRP1α targeting moiety comprises a recognition domain that recognizes one or more epitopes present on human SIRP1α. In an embodiment, the SIRP1α targeting moiety comprises a recognition domain that recognizes human SIRP1α with a signal peptide sequence. An exemplary human SIRP1α polypeptide is SEQ ID NO: 1006.

In an embodiment, the SIRP1α targeting moiety comprises a recognition domain that recognizes human SIRP1α without a signal peptide sequence. An exemplary human SIRP1α polypeptide without a signal peptide sequence is SEQ ID NO: 1007.

In an embodiment, the SIRP1α targeting moiety comprises a recognition domain that recognizes a polypeptide encoding human SIRP1α isoform 2 (SEQ ID NO: 1008).

In an embodiment, the SIRP1α targeting moiety comprises a recognition domain that recognizes a polypeptide encoding human SIRP1α isoform 4 (SEQ ID NO: 1009).

In various embodiments, the SIRP1α targeting moieties may be any protein-based agent capable of specific binding, such as an antibody or derivatives thereof. In an embodiment, the SIRP1α targeting moiety comprises an antibody. In various embodiments, the antibody is a full-length multimeric protein that includes two heavy chains and two light chains. Each heavy chain includes one variable region (e.g., $V_H$) and at least three constant regions (e.g., $CH_1$, $CH_2$ and $CH_3$), and each light chain includes one variable region ($V_L$) and one constant region ($C_L$). The variable regions determine the specificity of the antibody. Each variable region comprises three hypervariable regions also known as complementarity determining regions (CDRs) flanked by four relatively conserved framework regions (FRs). The three CDRs, referred to as CDR1, CDR2, and CDR3, contribute to the antibody binding specificity. In some embodiments, the antibody is a chimeric antibody. In some embodiments, the antibody is a humanized antibody.

In some embodiments, the SIRP1α targeting moiety comprises antibody derivatives or formats. In some embodiments, the SIRP1α targeting moiety is a single-domain antibody, a recombinant heavy-chain-only antibody (VHH), a single-chain antibody (scFv), a shark heavy-chain-only antibody (VNAR), a microprotein (cysteine knot protein, knottin), a DARPin; a Tetranectin; an Affibody; a Transbody; an Anticalin; an AdNectin; an Affilin; a Microbody; a peptide aptamer; an alterase; a plastic antibodies; a phylomer; a stradobody; a maxibody; an evibody; a fynomer, an armadillo repeat protein, a Kunitz domain, an avimer, an atrimer, a probody, an immunobody, a triomab, a troybody; a pepbody; a vaccibody, a UniBody; Affimers, a DuoBody, a Fv, a Fab, a Fab', a F(ab')$_2$, a peptide mimetic molecule, or a synthetic molecule, as described in US Patent Nos. or Patent Publication Nos. U.S. Pat. No. 7,417,130, US 2004/132094, U.S. Pat. No. 5,831,012, US 2004/023334, U.S. Pat. Nos. 7,250,297, 6,818,418, US 2004/209243, U.S. Pat. Nos. 7,838,629, 7,186,524, 6,004,746, 5,475,096, US 2004/146938, US 2004/157209, U.S. Pat. Nos. 6,994,982, 6,794,144, US 2010/239633, U.S. Pat. No. 7,803,907, US 2010/119446, and/or U.S. Pat. No. 7,166,697, the contents of which are hereby incorporated by reference in their entireties. See also, Storz MAbs. 2011 May-June; 3(3): 310-317.

In one embodiment, the SIRP1α targeting comprises a single-domain antibody, such as VHH from, for example, an organism that produces VHH antibody such as a camelid, a shark, or a designed VHH. VHHs are antibody-derived therapeutic proteins that contain the unique structural and functional properties of naturally-occurring heavy-chain antibodies. VHH technology is based on fully functional antibodies from camelids that lack light chains. These heavy-chain antibodies contain a single variable domain (VHH) and two constant domains (CH2 and CH3).

In an embodiment, the SIRP1α targeting moiety comprises a VHH. In some embodiments, the VHH is a humanized VHH or camelized VHH.

In some embodiments, the VHH comprises a fully human $V_H$ domain, e.g. a HUMABODY (Crescendo Biologics, Cambridge, UK). In some embodiments, fully human $V_H$ domain, e.g. a HUMABODY is monovalent, bivalent, or trivalent. In some embodiments, the fully human $V_H$ domain, e.g. a HUMABODY is mono- or multi-specific such as monospecific, bispecific, or trispecific. Illustrative fully human $V_H$ domains, e.g. a HUMABODIES are described in, for example, WO 2016/113555 and WO2016/113557, the entire disclosure of which is incorporated by reference.

For example, in some embodiments, the SIRP1α targeting moiety comprises one or more antibodies, antibody derivatives or formats, peptides or polypeptides, VHHs, or fusion proteins that selectively bind SIRP1α. In some embodiments, the SIRP1α targeting moiety comprises an antibody or derivative thereof that specifically binds to SIRP1α. In some embodiments, the SIRP1α targeting moiety is a camelid heavy chain antibody (VHH) that specifically binds to SIRP1α.

In various embodiments, the SIRP1α targeting moieties may comprise any combination of heavy chain, light chain, heavy chain variable region, light chain variable region, complementarity determining region (CDR), and framework region sequences that is known to recognize and bind to SIRP1α.

In various embodiments, the present technology contemplates the use of any natural or synthetic analogs, mutants, variants, alleles, homologs and orthologs (herein collectively referred to as "analogs") of the SIRP1α targeting moiety described herein. In various embodiments, the amino acid sequence of the SIRP1α targeting moiety further includes an amino acid analog, an amino acid derivative, or other non-classical amino acids.

In various embodiments, the SIRP1α targeting moieties comprise an amino acid sequence having one or more amino acid mutations with respect to any targeting moiety sequence that is known to recognize and bind to SIRP1α.

In various embodiments, the SIRP1α targeting moiety comprises an amino acid sequence having one, or two, or three, or four, or five, or six, or seen, or eight, or nine, or ten, or fifteen, twenty, thirty, forty, or fifty amino acid mutations with respect to any targeting moiety sequence, which is known to recognize and bind to SIRP1α. In some embodiments, the one or more amino acid mutations may be independently selected from substitutions, insertions, deletions, and truncations.

In some embodiments, the amino acid mutations are amino acid substitutions, and may include conservative and/or non-conservative substitutions.

"Conservative substitutions" may be made, for instance, on the basis of similarity in polarity, charge, size, solubility, hydrophobicity, hydrophilicity, and/or the amphipathic nature of the amino acid residues involved. The 20 naturally occurring amino acids can be grouped into the following six standard amino acid groups: (1) hydrophobic: Met, Ala, Val, Leu, Ile; (2) neutral hydrophilic: Cys, Ser, Thr; Asn, Gln; (3) acidic: Asp, Glu; (4) basic: His, Lys, Arg; (5) residues that influence chain orientation: Gly, Pro; and (6) aromatic: Trp, Tyr, Phe.

As used herein, "conservative substitutions" are defined as exchanges of an amino acid by another amino acid listed within the same group of the six standard amino acid groups shown above. For example, the exchange of Asp by Glu retains one negative charge in the so modified polypeptide. In addition, glycine and proline may be substituted for one another based on their ability to disrupt α-helices.

As used herein, "non-conservative substitutions" are defined as exchanges of an amino acid by another amino acid listed in a different group of the six standard amino acid groups (1) to (6) shown above.

In various embodiments, the substitutions may also include non-classical amino acids. Exemplary non-classical amino acids include, but are not limited to, selenocysteine, pyrrolysine, N-formylmethionine β-alanine, GABA and δ-Aminolevulinic acid, 4-aminobenzoic acid (PABA), D-isomers of the common amino acids, 2,4-diaminobutyric acid, α-amino isobutyric acid, 4-aminobutyric acid, Abu, 2-amino butyric acid, γ-Abu, ε-Ahx, 6-amino hexanoic acid, Aib, 2-amino isobutyric acid, 3-amino propionic acid, ornithine, norleucine, norvaline, hydroxyproline, sarcosme, citrulline, homocitrulline, cysteic acid, t-butylglycine, t-butylalanine, phenylglycine, cyclohexylalanine, β-alanine, fluoro-amino acids, designer amino acids such as p methyl amino acids, C α-methyl amino acids, N α-methyl amino acids, and amino acid analogs in general.

In various embodiments, the amino acid mutation may be in the CDRs of the targeting moiety (e.g., the CDR1, CDR2 or CDR3 regions). In another embodiment, amino acid alteration may be in the framework regions (FRs) of the targeting moiety (e.g., the FR1, FR2, FR3, or FR4 regions).

Modification of the amino acid sequences may be achieved using any known technique in the art e.g., site-directed mutagenesis or PCR based mutagenesis. Such techniques are described, for example, in Sambrook et al., Molecular Cloning: A Laboratory Manual, Cold Spring Harbor Press, Plainview, N.Y., 1989 and Ausubel et al., Current Protocols in Molecular Biology, John Wiley & Sons, New York, N.Y., 1989.

In various embodiments, the mutations do not substantially reduce the SIRP1α targeting moiety's capability to specifically recognize and bind to SIRP1α. In various embodiments, the mutations do not substantially reduce the SIRP1α targeting moiety's capability to specifically bind to SIRP1α and without functionally modulating (e.g., partially or fully neutralizing) SIRP1α.

In various embodiments, the SIRP1α targeting moiety binds but does not functionally modulate the antigen of interest, i.e., SIRP1α. For instance, in various embodiments, the SIRP1α targeting moiety simply targets the antigen but does not substantially functionally modulate (e.g. substantially inhibit, reduce or neutralize) a biological effect that the antigen has. In various embodiments, the SIRP1α targeting moiety binds an epitope that is physically separate from an antigen site that is important for its biological activity (e.g. an antigen's active site).

In other embodiments, the SIRP1α targeting moiety binds and functionally modulates the antigen of interest, i.e., SIRP1α. For instance, in various embodiments, the SIRP1α targeting moiety targets the antigen, i.e., SIRP1α, and functionally modulates (e.g. inhibit, reduce or neutralize) a biological effect that the antigen has. Such binding along with functional modulation may find use in various embodiments of the present invention including methods in which the present chimeric protein is used to directly or indirectly recruit active immune cells to a site of need via an effector antigen.

In various embodiments, the multi-specific Clec9A binding agent of the invention comprises a targeting moiety having an antigen recognition domain that specifically binds to XCR1, e.g. on DCs. In various embodiments, the multi-specific Clec9A binding agent of the invention comprises a targeting moiety having an antigen recognition domain that comprise all of or part of XCL1.

In various embodiments, the multi-specific Clec9A binding agents have targeting moieties having recognition domains which specifically bind to a target (e.g. antigen, receptor) which is part of a non-cellular structure. In some embodiments, the antigen or receptor is not an integral component of an intact cell or cellular structure. In some embodiments, the antigen or receptor is an extracellular antigen or receptor. In some embodiments, the target is a non-proteinaceous, non-cellular marker, including, without limitation, nucleic acids, inclusive of DNA or RNA, such as, for example, DNA released from necrotic tumor cells or extracellular deposits such as cholesterol.

In some embodiments, the target (e.g. antigen, receptor) of interest is part of the non-cellular component of the stroma or the extracellular matrix (ECM) or the markers associated therewith. As used herein, stroma refers to the connective and supportive framework of a tissue or organ. Stroma may include a compilation of cells such as fibroblasts/myofibroblasts, glial, epithelia, fat, immune, vascular, smooth muscle, and immune cells along with the extracellular matrix (ECM) and extracellular molecules. In various embodiments, the target (e.g. antigen, receptor) of interest is part of the non-cellular component of the stroma such as the extracellular matrix and extracellular molecules. As used herein, the ECM refers to the non-cellular components present within all tissues and organs. The ECM is composed of a large collection of biochemically distinct components including, without limitation, proteins, glycoproteins, proteoglycans, and polysaccharides. These components of the ECM are usually produced by adjacent cells and secreted into the ECM via exocytosis. Once secreted, the ECM components often aggregate to form a complex network of macromolecules. In various embodiments, the chimeric protein of the invention comprises a targeting moiety that recognizes a target (e.g., an antigen or receptor or non-proteinaceous molecule) located on any component of the ECM. Illustrative components of the ECM include, without limitation, the proteoglycans, the non-proteoglycan polysaccharides, fibers, and other ECM proteins or ECM non-proteins, e.g. polysaccharides and/or lipids, or ECM associated molecules (e.g. proteins or non-proteins, e.g. polysaccharides, nucleic acids and/or lipids).

In some embodiments, the targeting moiety recognizes a target (e.g. antigen, receptor) on ECM proteoglycans. Proteoglycans are glycosylated proteins. The basic proteoglycan unit includes a core protein with one or more covalently attached glycosaminoglycan (GAG) chains. Proteoglycans have a net negative charge that attracts positively charged sodium ions (Na+), which attracts water molecules via osmosis, keeping the ECM and resident cells hydrated. Proteoglycans may also help to trap and store growth factors within the ECM. Illustrative proteoglycans that may be targeted by the chimeric proteins of the invention include, but are not limited to, heparan sulfate, chondroitin sulfate, and keratan sulfate. In an embodiment, the targeting moiety recognizes a target (e.g. antigen, receptor) on non-proteoglycan polysaccharides such as hyaluronic acid.

In some embodiments, the targeting moiety recognizes a target (e.g. antigen, receptor) on ECM fibers. ECM fibers include collagen fibers and elastin fibers. In some embodiments, the targeting moiety recognizes one or more epitopes on collagens or collagen fibers. Collagens are the most abundant proteins in the ECM. Collagens are present in the ECM as fibrillar proteins and provide structural support to resident cells. In one or more embodiments, the targeting moiety recognizes and binds to various types of collagens present within the ECM including, without limitation, fibrillar collagens (types I, II, III, V, XI), facit collagens (types IX, XII, XIV), short chain collagens (types VIII, X), basement membrane collagens (type IV), and/or collagen types VI, VII, or XIII. Elastin fibers provide elasticity to tissues, allowing them to stretch when needed and then return to their original state. In some embodiments, the target moiety recognizes one or more epitopes on elastins or elastin fibers.

In some embodiments, the targeting moiety recognizes one or more ECM proteins including, but not limited to, a tenascin, afibronectin, afibrin, a laminin, or a nidogen/entactin.

In an embodiment, the targeting moiety recognizes and binds to tenascin. The tenascin (TN) family of glycoproteins includes at least four members, tenascin-C, tenascin-R, tenascin-X, and tenascin W. The primary structures of tenascin proteins include several common motifs ordered in the same consecutive sequence: amino-terminal heptad repeats, epidermal growth factor (EGF)-like repeats, fibronectin type III domain repeats, and a carboxyl-terminal fibrinogen-like globular domain. Each protein member is associated with typical variations in the number and nature of EGF-like and fibronectin type III repeats. Isoform variants also exist particularly with respect to tenascin-C. Over 27 splice variants and/or isoforms of tenascin-C are known. In a particular embodiment, the targeting moiety recognizes and binds to tenascin-CA1. Similarly, tenascin-R also has various splice variants and isoforms. Tenascin-R usually exists as dimers or trimers. Tenascin-X is the largest member of the tenascin family and is known to exist as trimers. Tenascin-W exists as trimers. In some embodiments, the targeting moiety recognizes one or more epitopes on a tenascin protein. In some embodiments, the targeting moiety recognizes the monomeric and/or the dimeric and/or the trimeric and/or the hexameric forms of a tenascin protein.

In an embodiment, the targeting moieties recognize and bind to fibronectin. Fibronectins are glycoproteins that connect cells with collagen fibers in the ECM, allowing cells to move through the ECM. Upon binding to integrins, fibronectins unfolds to form functional dimers. In some embodiments, the targeting moiety recognizes the monomeric and/or the dimeric forms of fibronectin. In some embodiments, the targeting moiety recognizes one or more epitopes on fibronectin. In illustrative embodiments, the targeting moiety recognizes fibronectin extracellular domain A (EDA) or fibronectin extracellular domain B (EDB). Elevated levels of EDA are associated with various diseases and disorders including psoriasis, rheumatoid arthritis, diabetes, and cancer. In some embodiments, the targeting moiety recognizes fibronectin that contains the EDA isoform and may be utilized to target the chimeric protein to diseased cells including cancer cells. In some embodiments, the targeting moiety recognizes fibronectin that contains the EDB isoform. In various embodiments, such targeting moieties may be utilized to target the chimeric protein to tumor cells including the tumor neovasculature.

In an embodiment, the targeting moiety recognizes and binds to fibrin. Fibrin is another protein substance often found in the matrix network of the ECM. Fibrin is formed by the action of the protease thrombin on fibrinogen which causes the fibrin to polymerize. In some embodiments, the targeting moiety recognizes one or more epitopes on fibrin. In some embodiments, the targeting moiety recognizes the monomeric as well as the polymerized forms of fibrin.

In an embodiment, the targeting moiety recognizes and binds to laminin. Laminin is a major component of the basal lamina, which is a protein network foundation for cells and organs. Laminins are heterotrimeric proteins that contain an α-chain, a β-chain, and a γ-chain. In some embodiments, the targeting moiety recognizes one or more epitopes on laminin. In some embodiments, the targeting moiety recognizes the monomeric, the dimeric as well as the trimeric forms of laminin.

In an embodiment, the targeting moiety recognizes and binds to a nidogen or entactin. Nidogens/entactins are a family of highly conserved, sulfated glycoproteins. They make up the major structural component of the basement membranes and function to link laminin and collagen IV networks in basement membranes. Members of this family include nidogen-1 and nidogen-2. In various embodiments, the targeting moiety recognizes an epitope on nidogen-1 and/or nidogen-2.

In various embodiments, the targeting moiety comprises an antigen recognition domain that recognizes an epitope present on any of the targets (e.g., ECM proteins) described herein. In an embodiment, the antigen-recognition domain recognizes one or more linear epitopes present on the protein. As used herein, a linear epitope refers to any continuous sequence of amino acids present on the protein. In another embodiment, the antigen-recognition domain recognizes one or more conformational epitopes present on the protein. As used herein, a conformation epitope refers to one or more sections of amino acids (which may be discontinuous) which form a three-dimensional surface with features and/or shapes and/or tertiary structures capable of being recognized by an antigen recognition domain.

In various embodiments, the targeting moiety may bind to the full-length and/or mature forms and/or isoforms and/or splice variants and/or fragments and/or any other naturally occurring or synthetic analogs, variants, or mutants of any of the targets (e.g., ECM proteins) described herein. In various embodiments, the targeting moiety may bind to any forms of the proteins described herein, including monomeric, dimeric, trimeric, tetrameric, heterodimeric, multimeric and associated forms. In various embodiments, the targeting moiety may bind to any post-translationally modified forms of the proteins described herein, such as glycosylated and/or phosphorylated forms.

In various embodiments, the targeting moiety comprises an antigen recognition domain that recognizes extracellular molecules such as DNA. In some embodiments, the targeting moiety comprises an antigen recognition domain that recognizes DNA. In an embodiment, the DNA is shed into the extracellular space from necrotic or apoptotic tumor cells or other diseased cells.

In various embodiments, the targeting moiety comprises an antigen recognition domain that recognizes one or more non-cellular structures associated with atherosclerotic plaques. Two types of atherosclerotic plaques are known. The fibro-lipid (fibro-fatty) plaque is characterized by an accumulation of lipid-laden cells underneath the intima of the arteries. Beneath the endothelium there is a fibrous cap covering the atheromatous core of the plaque.

The core includes lipid-laden cells (macrophages and smooth muscle cells) with elevated tissue cholesterol and cholesterol ester content, fibrin, proteoglycans, collagen, elastin, and cellular debris. In advanced plaques, the central core of the plaque usually contains extracellular cholesterol deposits (released from dead cells), which form areas of cholesterol crystals with empty, needle-like clefts. At the periphery of the plaque are younger foamy cells and capillaries. A fibrous plaque is also localized under the intima, within the wall of the artery resulting in thickening and expansion of the wall and, sometimes, spotty localized narrowing of the lumen with some atrophy of the muscular layer. The fibrous plaque contains collagen fibers (eosinophilic), precipitates of calcium (hematoxylinophilic) and lipid-laden cells. In some embodiments, the targeting moiety recognizes and binds to one or more of the non-cellular components of these plaques such as the fibrin, proteoglycans, collagen, elastin, cellular debris, and calcium or other mineral deposits or precipitates. In some embodiments, the cellular debris is a nucleic acid, e.g. DNA or RNA, released from dead cells.

In various embodiments, the targeting moiety comprises an antigen recognition domain that recognizes one or more non-cellular structures found in the brain plaques associated with neurodegenerative diseases. In some embodiments, the targeting moiety recognizes and binds to one or more non-cellular structures located in the amyloid plaques found in the brains of patients with Alzheimer's disease. For example, the targeting moiety may recognize and bind to the peptide amyloid beta, which is a major component of the amyloid plaques. In some embodiments, the targeting moiety recognizes and binds to one or more non-cellular structures located in the brains plaques found in patients with Huntington's disease. In various embodiments, the targeting moiety recognizes and binds to one or more non-cellular structures found in plaques associated with other neurodegenerative or musculoskeletal diseases such as Lewy body dementia and inclusion body myositis.

Linkers and Functional Groups

In various embodiments, the Clec9A binding agent may include one or more functional groups, residues, or moieties. In various embodiments, the one or more functional groups, residues, or moieties are attached or genetically fused to any of the signaling agents or targeting moieties described herein. In some embodiments, such functional groups, residues or moieties confer one or more desired properties or functionalities to the Clec9A binding agent of the invention. Examples of such functional groups and of techniques for introducing them into the Clec9A binding agent are known in the art, for example, see Remington's Pharmaceutical Sciences, 16th ed., Mack Publishing Co., Easton, Pa. (1980).

In various embodiments, the Clec9A binding agent may by conjugated and/or fused with another agent to extend half-life or otherwise improve pharmacodynamic and pharmacokinetic properties. In some embodiments, the Clec9A binding agent may be fused or conjugated with one or more of PEG, XTEN (e.g., as rPEG), polysialic acid (POLYXEN), albumin (e.g., human serum albumin or HAS), elastin-like protein (ELP), PAS, HAP, GLK, CTP, transferrin, and the like. In some embodiments, the Clec9A binding agent may be fused or conjugated with an antibody or an antibody fragment such as an Fc fragment. For example, the chimeric protein may be fused to either the N-terminus or the C-terminus of the Fc domain of human immunoglobulin (Ig) G. In various embodiments, each of the individual chimeric proteins is fused to one or more of the agents described in BioDrugs (2015) 29:215-239, the entire contents of which are hereby incorporated by reference.

In some embodiments, the functional groups, residues, or moieties comprise a suitable pharmacologically acceptable polymer, such as poly(ethyleneglycol) (PEG) or derivatives thereof (such as methoxypoly(ethyleneglycol) or mPEG). In some embodiments, attachment of the PEG moiety increases the half-life and/or reduces the immunogenecity of the Clec9A binding protein. Generally, any suitable form of pegylation can be used, such as the pegylation used in the art for antibodies and antibody fragments (including but not limited to single domain antibodies such as VHHs); see, for example, Chapman, Nat. Biotechnol., 54, 531-545 (2002); by Veronese and Harris, Adv. Drug Deliv. Rev. 54, 453-456 (2003), by Harris and Chess, Nat. Rev. Drug. Discov., 2, (2003) and in WO/04060965, the entire contents of which are hereby incorporated by reference. Various reagents for pegylation of proteins are also commercially available, for example, from Nektar Therapeutics, USA. In some embodiments, site-directed pegylation is used, in particular via a cysteine-residue (see, for example, Yang et al., Protein Engineering, 16, 10, 761-770 (2003), the entire contents of which is hereby incorporated by reference). For example, for this purpose, PEG may be attached to a cysteine residue that naturally occurs in the Clec9A binding agent of the invention. In some embodiments, the Clec9A binding agent of the invention is modified so as to suitably introduce one or more cysteine residues for attachment of PEG, or an amino acid sequence comprising one or more cysteine residues for attachment of PEG may be fused to the amino- and/or carboxy-terminus of the Clec9A binding agent, using techniques known in the art.

In some embodiments, the functional groups, residues, or moieties comprise N-linked or O-linked glycosylation. In some embodiments, the N-linked or O-linked glycosylation is introduced as part of a co-translational and/or post-translational modification.

In some embodiments, the functional groups, residues, or moieties comprise one or more detectable labels or other signal-generating groups or moieties. Suitable labels and techniques for attaching, using and detecting them are known in the art and, include, but are not limited to, fluorescent labels (such as fluorescein, isothiocyanate, rhodamine, phycoerythrin, phycocyanin, allophycocyanin, o-phthaldehyde, and fluorescamine and fluorescent metals such as Eu or others metals from the lanthanide series), phosphorescent labels, chemiluminescent labels or bioluminescent labels (such as luminal, isoluminol, theromatic acridinium ester, imidazole, acridinium salts, oxalate ester, dioxetane or GFP and its analogs), radio-isotopes, metals, metals chelates or metallic cations or other metals or metallic cations that are particularly suited for use in in vivo, in vitro or in situ diagnosis and imaging, as well as chromophores and enzymes (such as malate dehydrogenase, staphylococcal nuclease, delta-V-steroid isomerase, yeast alcohol dehydrogenase, alpha-glycerophosphate dehydrogenase, triose phosphate isomerase, biotinavidin peroxidase, horseradish peroxidase, alkaline phosphatase, asparaginase, glucose oxidase, beta-galactosidase, ribonuclease, urease, catalase, glucose-VI-phosphate dehydrogenase, glucoamylase and acetylcholine esterase). Other suitable labels include moieties that can be detected using NMR or ESR spectroscopy. Such labeled VHHs and polypeptides of the invention may, for example, be used for in vitro, in vivo or in situ assays (including immunoassays known per se such as ELISA, RIA, EIA and other "sandwich assays," etc.) as well as in vivo diagnostic and imaging purposes, depending on the choice of the specific label.

In some embodiments, the functional groups, residues, or moieties comprise a tag that is attached or genetically fused to the Clec9A binding agent. In some embodiments, the Clec9A binding agent may include a single tag or multiple tags. The tag for example is a peptide, sugar, or DNA molecule that does not inhibit or prevent binding of the Clec9A binding agent to Clec9A or any other antigen of interest such as tumor antigens. In various embodiments, the tag is at least about: three to five amino acids long, five to eight amino acids long, eight to twelve amino acids long, twelve to fifteen amino acids long, or fifteen to twenty amino acids long. Illustrative tags are described for example, in U.S. Patent Publication No. US2013/0058962. In some embodiment, the tag is an affinity tag such as glutathione-S-transferase (GST) and histidine (His) tag. In an embodiment, the Clec9A binding agent comprises a His tag.

In some embodiments, the functional groups, residues, or moieties comprise a chelating group, for example, to chelate one of the metals or metallic cations. Suitable chelating groups, for example, include, without limitation, diethylenetriaminepentaacetic acid (DTPA) or ethylenediaminetetraacetic acid (EDTA).

In some embodiments, the functional groups, residues, or moieties comprise a functional group that is one part of a specific binding pair, such as the biotin-(strept)avidin binding pair. Such a functional group may be used to link the Clec9A binding agent of the invention to another protein, polypeptide or chemical compound that is bound to the other half of the binding pair, i.e., through formation of the binding pair. For example, a Clec9A binding agent of the invention may be conjugated to biotin, and linked to another protein, polypeptide, compound or carrier conjugated to avidin or streptavidin. For example, such a conjugated Clec9A binding agent may be used as a reporter, for example, in a diagnostic system where a detectable signal-producing agent is conjugated to avidin or streptavidin. Such binding pairs may, for example, also be used to bind the Clec9A binding agent to a carrier, including carriers suitable for pharmaceutical purposes. One non-limiting example are the liposomal formulations described by Cao and Suresh, *Journal of Drug Targeting*, 8, 4, 257 (2000). Such binding pairs may also be used to link a therapeutically active agent to the Clec9A binding agent of the invention.

In some embodiments, the present Clec9A binding agent optionally comprises one or more linkers. In some embodiments, the Clec9A binding agent includes a linker that connects each binding region and/or targeting moieties. In some embodiments, the Clec9A binding agent includes a linker that connects each signaling agent and targeting moiety (or, if more than one targeting moiety, a signaling agent to one of the targeting moieties). In some embodiments, the linker may be utilized to link various functional groups, residues, or moieties as described herein to the Clec9A binding agent. In some embodiments, the linker is a single amino acid or a plurality of amino acids that does not affect or reduce the stability, orientation, binding, neutralization, and/or clearance characteristics of the binding regions and the binding protein. In various embodiments, the linker is selected from a peptide, a protein, a sugar, or a nucleic acid.

In some embodiments, the present Clec9A binding agent comprises a linker connecting the targeting moiety and the signaling agent. In some embodiments, the present chimeric protein comprises a linker within the signaling agent (e.g. in the case of single chain TNF, which can comprise two linkers to yield a trimer).

The invention contemplates the use of a variety of linker sequences. In various embodiments, the linker may be derived from naturally-occurring multi-domain proteins or are empirical linkers as described, for example, in Chichili et al., (2013), Protein Sci. 22(2):153-167, Chen et al., (2013), Adv Drug Deliv Rev. 65(10):1357-1369, the entire contents of which are hereby incorporated by reference. In some embodiments, the linker may be designed using linker designing databases and computer programs such as those described in Chen et al., (2013), Adv Drug Deliv Rev. 65(10):1357-1369 and Crasto et al., (2000), Protein Eng. 13(5):309-312, the entire contents of which are hereby incorporated by reference. In various embodiments, the linker may be functional. For example, without limitation, the linker may function to improve the folding and/or stability, improve the expression, improve the pharmacokinetics, and/or improve the bioactivity of the present Clec9A binding agent.

In some embodiments, the linker is a polypeptide. In some embodiments, the linker is less than about 100 amino acids long. For example, the linker may be less than about 100, about 95, about 90, about 85, about 80, about 75, about 70, about 65, about 60, about 55, about 50, about 45, about 40, about 35, about 30, about 25, about 20, about 19, about 18, about 17, about 16, about 15, about 14, about 13, about 12, about 11, about 10, about 9, about 8, about 7, about 6, about 5, about 4, about 3, or about 2 amino acids long. In some embodiments, the linker is a polypeptide. In some embodiments, the linker is greater than about 100 amino acids long. For example, the linker may be greater than about 100, about 95, about 90, about 85, about 80, about 75, about 70, about 65, about 60, about 55, about 50, about 45, about 40, about 35, about 30, about 25, about 20, about 19, about 18, about 17, about 16, about 15, about 14, about 13, about 12, about 11, about 10, about 9, about 8, about 7, about 6, about 5, about 4, about 3, or about 2 amino acids long. In some embodiments, the linker is flexible. In another embodiment, the linker is rigid.

In some embodiments, the linker length allows for efficient binding of a targeting moiety and the signaling agent to their receptors. For instance, in some embodiments, the linker length allows for efficient binding of one of the targeting moieties and the signaling agent to receptors on the same cell as well as the efficient binding of the other targeting moiety to another cell. Illustrative pairs of cells are provided elsewhere herein.

In some embodiments the linker length is at least equal to the minimum distance between the binding sites of one of the targeting moieties and the signaling agent to receptors on the same cell. In some embodiments the linker length is at least twice, or three times, or four times, or five times, or ten times, or twenty times, or 25 times, or 50 times, or one hundred times, or more the minimum distance between the binding sites of one of the targeting moieties and the signaling agent to receptors on the same cell.

In some embodiments, a linker connects the two targeting moieties to each other and this linker has a short length and a linker connects a targeting moiety and a signaling agent this linker is longer than the linker connecting the two targeting moieties. For example, the difference in amino acid length between the linker connecting the two targeting moieties and the linker connecting a targeting moiety and a signaling agent may be about 100, about 95, about 90, about 85, about 80, about 75, about 70, about 65, about 60, about 55, about 50, about 45, about 40, about 35, about 30, about 25, about 20, about 19, about 18, about 17, about 16, about 15, about 14, about 13, about 12, about 11, about 10, about 9, about 8, about 7, about 6, about 5, about 4, about 3, or about 2 amino acids. In some embodiments, the linker is flexible. In another embodiment, the linker is rigid.

In various embodiments, the linker is substantially comprised of glycine and serine residues (e.g. about 30%, or about 40%, or about 50%, or about 60%, or about 70%, or about 80%, or about 90%, or about 95%, or about 97% glycines and serines). For example, in some embodiments, the linker is $(Gly_4Ser)_n$, where n is from about 1 to about 8, e.g. 1, 2, 3, 4, 5, 6, 7, or 8 (SEQ ID NOs: 1010-1017). In an embodiment, the linker sequence is GGSGGSGGGGSGGGGS (SEQ ID NO: 1018). Additional illustrative linkers include, but are not limited to, linkers having the sequence LE, GGGGS (SEQ ID NO: 1010), $(GGGGS)_n$ (n=1-4) (SEQ ID NOs: 1010-1013), $(Gly)_8$ (SEQ ID NO: 1019), $(Gly)_6$ (SEQ ID NO: 1020), $(EAAAK)_n$ (n=1-3) (SEQ ID NOs: 1021-1023):, $A(EAAAK)_nA$ (n=2-5) (SEQ ID NO: 1024-1027), AEAAAKEAAAKA (SEQ ID NO: 1024), $A(EAAAK)_4ALEA(EAAAK)_4A$ (SEQ ID NO: 1028), PAPAP (SEQ ID NO: 1029), KESGSVSSE-QLAQFRSLD (SEQ ID NO: 1030), EGKSSGSGSESKST (SEQ ID NO: 1031), GSAGSAAGSGEF (SEQ ID NO: 1032), and $(XP)_n$, with X designating any amino acid, e.g., Ala, Lys, or Glu. In various embodiments, the linker is $(GGS)_n$ (n=1-20) (SEQ ID NO: 1033-SEQ ID NO: 1052). In some embodiments, the linker is G. In some embodiments, the linker is AAA. In some embodiments, the linker is $(GGGGS)_n$ (n=9-20) (SEQ ID NOs: 1053-1064).

In some embodiments, the linker is one or more of GGGSE (SEQ ID NO: 1065), GSESG (SEQ ID NO: 1066), GSEGS (SEQ ID NO: 1067), GEGGSGEGSSGEGSSEGGGSEGGGSEGGGSEGGS (SEQ ID NO: 1068), and a linker of randomly placed G, S, and E every 4 amino acid intervals.

In some embodiments, a Clec9A binding agent is linked to a modified signaling agent. In various exemplary embodiments, the Clec9A binding agent is linked to a modified IFNα2. By way of example, in some embodiments, a Clec9A binding agent linked to a modified IFNα2 is represented as R1CHCL50-linker-hIFNα2_R149A or 3LEC89-linker-hIFNα2_R149A, wherein the linker is any of the above disclosed linkers.

In some embodiments, the linker is a hinge region of an antibody (e.g., of IgG, IgA, IgD, and IgE, inclusive of subclasses (e.g. IgG1, IgG2, IgG3, and IgG4, and IgA1 and IgA2)). In various embodiments, the linker is a hinge region of an antibody (e.g., of IgG, IgA, IgD, and IgE, inclusive of subclasses (e.g. IgG1, IgG2, IgG3, and IgG4, and IgA1 and IgA2)). The hinge region, found in IgG, IgA, IgD, and IgE class antibodies, acts as a flexible spacer, allowing the Fab portion to move freely in space. In contrast to the constant regions, the hinge domains are structurally diverse, varying in both sequence and length among immunoglobulin classes and subclasses. For example, the length and flexibility of the hinge region varies among the IgG subclasses. The hinge region of IgG1 encompasses amino acids 216-231 and, because it is freely flexible, the Fab fragments can rotate about their axes of symmetry and move within a sphere centered at the first of two inter-heavy chain disulfide bridges. IgG2 has a shorter hinge than IgG1, with 12 amino acid residues and four disulfide bridges. The hinge region of IgG2 lacks a glycine residue, is relatively short, and contains a rigid poly-proline double helix, stabilized by extra inter-heavy chain disulfide bridges. These properties restrict the flexibility of the IgG2 molecule. IgG3 differs from the other subclasses by its unique extended hinge region (about four times as long as the IgG1 hinge), containing 62 amino acids (including 21 prolines and 11 cysteines), forming an inflexible poly-proline double helix. In IgG3, the Fab fragments are relatively far away from the Fc fragment, giving the molecule a greater flexibility. The elongated hinge in IgG3 is also responsible for its higher molecular weight compared to the other subclasses. The hinge region of IgG4 is shorter than that of IgG1 and its flexibility is intermediate between that of IgG1 and IgG2. The flexibility of the hinge regions reportedly decreases in the order IgG3>IgG1>IgG4>IgG2.

According to crystallographic studies, the immunoglobulin hinge region can be further subdivided functionally into three regions: the upper hinge region, the core region, and the lower hinge region. See Shin et al., 1992 *Immunological Reviews* 130:87. The upper hinge region includes amino acids from the carboxyl end of $C_{H1}$ to the first residue in the hinge that restricts motion, generally the first cysteine residue that forms an interchain disulfide bond between the two heavy chains. The length of the upper hinge region correlates with the segmental flexibility of the antibody. The core hinge region contains the inter-heavy chain disulfide bridges, and the lower hinge region joins the amino terminal end of the $C_{H2}$ domain and includes residues in $C_{H2}$. Id. The core hinge region of wild-type human IgG1 contains the sequence Cys-Pro-Pro-Cys (SEQ ID NO: 1069), which, when dimerized by disulfide bond formation, results in a cyclic octapeptide believed to act as a pivot, thus conferring flexibility. In various embodiments, the present linker comprises, one, or two, or three of the upper hinge region, the core region, and the lower hinge region of any antibody (e.g., of IgG, IgA, IgD, and IgE, inclusive of subclasses (e.g. IgG1, IgG2, IgG3, and IgG4, and IgA1 and IgA2)). The hinge region may also contain one or more glycosylation sites, which include a number of structurally distinct types of sites for carbohydrate attachment. For example, IgA1 contains five glycosylation sites within a 17-amino-acid segment of the hinge region, conferring resistance of the hinge region polypeptide to intestinal proteases, considered an advantageous property for a secretory immunoglobulin.

In various embodiments, the linker of the present invention comprises one or more glycosylation sites. In various embodiments, the linker is a hinge-CH2-CH3 domain of a human IgG4 antibody.

If desired, the present Clec9A binding agent can be linked to an antibody Fc region, comprising one or both of $C_{H2}$ and $C_{H3}$ domains, and optionally a hinge region. For example, vectors encoding the present Clec9A binding agents linked as a single nucleotide sequence to an Fc region can be used to prepare such polypeptides.

In some embodiments, the linker is a synthetic linker such as PEG.

In various embodiments, the linker may be functional. For example, without limitation, the linker may function to improve the folding and/or stability, improve the expression, improve the pharmacokinetics, and/or improve the bioactivity of the present Clec9A binding agent. In another example, the linker may function to target the Clec9A binding agent to a particular cell type or location.

Modifications and Production of Clec9A Binding Agents

In various embodiments, the Clec9A binding agent comprises a targeting moiety that is a VHH. In various embodiments, the VHH is not limited to a specific biological source or to a specific method of preparation. For example, the VHH can generally be obtained: (1) by isolating the $V_HH$ domain of a naturally occurring heavy chain antibody; (2) by expression of a nucleotide sequence encoding a naturally occurring $V_HH$ domain; (3) by "humanization" of a naturally occurring $V_HH$ domain or by expression of a nucleic acid encoding a such humanized $V_HH$ domain; (4) by "camelization" of a naturally occurring VH domain from any animal species, such as from a mammalian species, such as from a human being, or by expression of a nucleic acid encoding such a camelized VH domain; (5) by "camelization" of a "domain antibody" or "Dab" as described in the art, or by expression of a nucleic acid encoding such a camelized VH domain; (6) by using synthetic or semi-synthetic techniques for preparing proteins, polypeptides or other amino acid sequences known in the art; (7) by preparing a nucleic acid encoding a VHH using techniques for nucleic acid synthesis known in the art, followed by expression of the nucleic acid thus obtained; and/or (8) by any combination of one or more of the foregoing.

In an embodiment, the Clec9A binding agent comprises a VHH that corresponds to the $V_HH$ domains of naturally occurring heavy chain antibodies directed against human Clec9A. In some embodiments, such $V_HH$ sequences can generally be generated or obtained by suitably immunizing a species of Camelid with a Clec9A molecule, (i.e., so as to raise an immune response and/or heavy chain antibodies directed against Clec9A), by obtaining a suitable biological sample from the Camelid (such as a blood sample, or any sample of B-cells), and by generating $V_HH$ sequences directed against Clec9A, starting from the sample, using any suitable known techniques. In some embodiments, naturally occurring $V_HH$ domains against Clec9A can be obtained from naive libraries of Camelid $V_HH$ sequences, for example, by screening such a library using Clec9A or at least one part, fragment, antigenic determinant or epitope thereof using one or more screening techniques known in the art. Such libraries and techniques are, for example, described in WO9937681, WO0190190, WO03025020 and WO03035694, the entire contents of which are hereby incorporated by reference. In some embodiments, improved synthetic or semi-synthetic libraries derived from naive $V_HH$ libraries may be used, such as $V_HH$ libraries obtained from naive $V_HH$ libraries by techniques such as random mutagenesis and/or CDR shuffling, as for example, described in WO0043507, the entire contents of which are hereby incorporated by reference. In some embodiments, another technique for obtaining $V_HH$ sequences directed against a Clec9A involves suitably immunizing a transgenic mammal that is capable of expressing heavy chain antibodies (i.e., so as to raise an immune response and/or heavy chain antibodies directed against Clec9A), obtaining a suitable biological sample from the transgenic mammal (such as a blood sample, or any sample of B-cells), and then generating $V_HH$ sequences directed against Clec9A starting from the sample, using any suitable known techniques. For example, for this purpose, the heavy chain antibody-expressing mice and the further methods and techniques described in WO02085945 and in WO04049794 (the entire contents of which are hereby incorporated by reference) can be used.

In an embodiment, the Clec9A binding agent comprises a VHH that has been "humanized" i.e., by replacing one or more amino acid residues in the amino acid sequence of the naturally occurring $V_HH$ sequence (and in particular in the framework sequences) by one or more of the amino acid residues that occur at the corresponding position(s) in a VH domain from a conventional 4-chain antibody from a human being. This can be performed using humanization techniques known in the art. In some embodiments, possible humanizing substitutions or combinations of humanizing substitutions may be determined by methods known in the art, for example, by a comparison between the sequence of a VHH and the sequence of a naturally occurring human VH domain. In some embodiments, the humanizing substitutions are chosen such that the resulting humanized VHHs still retain advantageous functional properties. Generally, as a result of humanization, the VHHs of the invention may become more "human-like," while still retaining favorable properties such as a reduced immunogenicity, compared to the corresponding naturally occurring $V_HH$ domains. In various embodiments, the humanized VHHs of the invention can be obtained in any suitable manner known in the art and thus are not strictly limited to polypeptides that have been obtained using a polypeptide that comprises a naturally occurring $V_HH$ domain as a starting material.

In an embodiment, the Clec9A binding agent comprises a VHH that has been "camelized," i.e., by replacing one or more amino acid residues in the amino acid sequence of a naturally occurring VH domain from a conventional 4-chain antibody by one or more of the amino acid residues that occur at the corresponding position(s) in a $V_HH$ domain of a heavy chain antibody of a camelid. In some embodiments, such "camelizing" substitutions are inserted at amino acid positions that form and/or are present at the VH-VL interface, and/or at the so-called Camelidae hallmark residues (see, for example, WO9404678, the entire contents of which are hereby incorporated by reference). In some embodiments, the VH sequence that is used as a starting material or starting point for generating or designing the camelized VHH is a VH sequence from a mammal, for example, the VH sequence of a human being, such as a VH3 sequence. In various embodiments, the camelized VHHs can be obtained in any suitable manner known in the art (i.e., as indicated under points (1)-(8) above) and thus are not strictly limited to polypeptides that have been obtained using a polypeptide that comprises a naturally occurring VH domain as a starting material.

In various embodiments, both "humanization" and "camelization" can be performed by providing a nucleotide sequence that encodes a naturally occurring $V_HH$ domain or VH domain, respectively, and then changing, in a manner known in the art, one or more codons in the nucleotide sequence in such a way that the new nucleotide sequence encodes a "humanized" or "camelized" VHH, respectively. This nucleic acid can then be expressed in a manner known in the art, so as to provide the desired VHH of the invention. Alternatively, based on the amino acid sequence of a naturally occurring $V_HH$ domain or VH domain, respectively, the amino acid sequence of the desired humanized or camelized VHH of the invention, respectively, can be designed and then synthesized de novo using techniques for peptide synthesis known in the art. Also, based on the amino acid sequence or nucleotide sequence of a naturally occurring $V_HH$ domain or VH domain, respectively, a nucleotide sequence encoding the desired humanized or camelized VHH, respectively, can be designed and then synthesized de novo using techniques for nucleic acid synthesis known in the art, after which the nucleic acid thus obtained can be expressed in a manner known in the art, so as to provide the desired VHH of the invention. Other suitable methods and techniques for obtaining the VHHs of the invention and/or nucleic acids encoding the same, starting from naturally occurring VH sequences or $V_HH$ sequences, are known in the art, and may, for example, comprise combining one or more parts of one or more naturally occurring VH sequences (such as one or more FR sequences and/or CDR sequences), one or more parts of one or more naturally occurring $V_HH$ sequences (such as one or more FR sequences or CDR sequences), and/or one or more synthetic or semi-synthetic sequences, in a suitable manner, so as to provide a VHH of the invention or a nucleotide sequence or nucleic acid encoding the same.

Methods for producing the Clec9A binding agents of the invention are described herein. For example, DNA sequences encoding the Clec9A binding agents of the invention can be chemically synthesized using methods known in the art. Synthetic DNA sequences can be ligated to other appropriate nucleotide sequences, including, e.g., expression control sequences, to produce gene expression constructs encoding the desired Clec9A binding agents. Accordingly, in various embodiments, the present invention provides for isolated nucleic acids comprising a nucleotide sequence encoding the Clec9A binding agent of the invention.

Nucleic acids encoding the Clec9A binding agent of the invention can be incorporated (ligated) into expression vectors, which can be introduced into host cells through transfection, transformation, or transduction techniques. For example, nucleic acids encoding the Clec9A binding agent of the invention can be introduced into host cells by retroviral transduction. Illustrative host cells are E. coli cells, Chinese hamster ovary (CHO) cells, human embryonic kidney 293 (HEK 293) cells, HeLa cells, baby hamster kidney (BHK) cells, monkey kidney cells (COS), human hepatocellular carcinoma cells (e.g., Hep G2), and myeloma cells. Transformed host cells can be grown under conditions that permit the host cells to express the genes that encode the Clec9A binding agent of the invention. Accordingly, in various embodiments, the present invention provides expression vectors comprising nucleic acids that encode the Clec9A binding agent of the invention. In various embodiments, the present invention additional provides host cells comprising such expression vectors.

Specific expression and purification conditions will vary depending upon the expression system employed. For example, if a gene is to be expressed in E. coli, it is first cloned into an expression vector by positioning the engineered gene downstream from a suitable bacterial promoter, e.g., Trp or Tac, and a prokaryotic signal sequence. In another example, if the engineered gene is to be expressed in eukaryotic host cells, e.g., CHO cells, it is first inserted into an expression vector containing for example, a suitable eukaryotic promoter, a secretion signal, enhancers, and various introns. The gene construct can be introduced into the host cells using transfection, transformation, or transduction techniques.

The Clec9A binding agent of the invention can be produced by growing a host cell transfected with an expression vector encoding the Clec9A binding agent under conditions that permit expression of the protein. Following expression, the protein can be harvested and purified using techniques well known in the art, e.g., affinity tags such as glutathione-S-transferase (GST) and histidine (His) tags or by chromatography. In an embodiment, the Clec9A binding agent comprises a His tag. In an embodiment, the Clec9A binding agent comprises a His tag and a proteolytic site to allow cleavage of the His tag.

Accordingly, in various embodiments, the present invention provides for a nucleic acid encoding a Clec9A binding agent of the present invention. In various embodiments, the present invention provides for a host cell comprising a nucleic acid encoding a Clec9A binding agent of the present invention.

In various embodiments, the present Clec9A binding agent or chimeric protein comprising the same may be expressed in vivo, for instance, in a patient. For example, in various embodiments, the present Clec9A binding agent or chimeric protein comprising the same may administered in the form of nucleic acid which encodes the present Clec9A binding agents or chimeric proteins comprising the same. In various embodiments, the nucleic acid is DNA or RNA. In some embodiments, present Clec9A binding agent or chimeric protein comprising the same is encoded by a modified mRNA, i.e. an mRNA comprising one or more modified nucleotides. In some embodiments, the modified mRNA comprises one or modifications found in U.S. Pat. No. 8,278,036, the entire contents of which are hereby incorporated by reference. In some embodiments, the modified mRNA comprises one or more of m5C, m5U, m6A, s2U, Ψ, and 2'-O-methyl-U. In some embodiments, the present invention relates to administering a modified mRNA encoding one or more of the present chimeric proteins. In some embodiments, the present invention relates to gene therapy vectors comprising the same. In some embodiments, the present invention relates to gene therapy methods comprising the same. In various embodiments, the nucleic acid is in the form of an oncolytic virus, e.g. an adenovirus, reovirus, measles, herpes simplex, Newcastle disease virus or vaccinia.

Pharmaceutically Acceptable Salts and Excipients

The Clec9A binding agents (and/or any other therapeutic agents) described herein can possess a sufficiently basic functional group, which can react with an inorganic or organic acid, or a carboxyl group, which can react with an inorganic or organic base, to form a pharmaceutically acceptable salt. A pharmaceutically acceptable acid addition salt is formed from a pharmaceutically acceptable acid, as is well known in the art. Such salts include the pharmaceutically acceptable salts listed in, for example, *Journal of Pharmaceutical Science*, 66, 2-19 (1977) and *The Handbook of Pharmaceutical Salts; Properties, Selection, and Use*. P. H. Stahl and C. G. Wermuth (eds.), Verlag, Zurich (Switzerland) 2002, which are hereby incorporated by reference in their entirety.

Pharmaceutically acceptable salts include, by way of non-limiting example, sulfate, citrate, acetate, oxalate, chloride, bromide, iodide, nitrate, bisulfate, phosphate, acid phosphate, isonicotinate, lactate, salicylate, acid citrate, tartrate, oleate, tannate, pantothenate, bitartrate, ascorbate, succinate, maleate, gentisinate, fumarate, gluconate, glucaronate, saccharate, formate, benzoate, glutamate, methanesulfonate, ethanesulfonate, benzenesulfonate, p-toluenesulfonate, camphorsulfonate, pamoate, phenylacetate, trifluoroacetate, acrylate, chlorobenzoate, dinitrobenzoate, hydroxybenzoate, methoxybenzoate, methylbenzoate, o-acetoxybenzoate, naphthalene-2-benzoate, isobutyrate, phenylbutyrate, α-hydroxybutyrate, butyne-1,4-dicarboxylate, hexyne-1,4-dicarboxylate, caprate, caprylate, cinnamate, glycollate, heptanoate, hippurate, malate, hydroxymaleate, malonate, mandelate, mesylate, nicotinate, phthalate, teraphthalate, propiolate, propionate, phenylpropionate, sebacate, suberate, p-bromobenzenesulfonate, chlorobenzenesulfonate, ethylsulfonate, 2-hydroxyethylsulfonate, methylsulfonate, naphthalene-1-sulfonate, naphthalene-2-sulfonate, naphthalene-1,5-sulfonate, xylenesulfonate, and tartarate salts.

The term "pharmaceutically acceptable salt" also refers to a salt of the compositions of the present invention having an acidic functional group, such as a carboxylic acid functional group, and a base. Suitable bases include, but are not limited to, hydroxides of alkali metals such as sodium, potassium, and lithium; hydroxides of alkaline earth metal such as calcium and magnesium; hydroxides of other metals, such as aluminum and zinc; ammonia, and organic amines, such as unsubstituted or hydroxy-substituted mono-, di-, or trialkylamines, dicyclohexylamine; tributyl amine; pyridine; N-methyl, N-ethylamine; diethylamine; triethylamine; mono-, bis-, or tris-(2-OH-lower alkylamines), such as mono-; bis-, or tris-(2-hydroxyethyl)amine, 2-hydroxy-tert-butylamine, or tris-(hydroxymethyl)methylamine, N,N-di-lower alkyl-N-(hydroxyl-lower alkyl)-amines, such as N,N-dimethyl-N-(2-hydroxyethyl)amine or tri-(2-hydroxyethyl) amine; N-methyl-D-glucamine; and amino acids such as arginine, lysine, and the like.

In some embodiments, the compositions described herein are in the form of a pharmaceutically acceptable salt.

Pharmaceutical Compositions and Formulations

In various embodiments, the present invention pertains to pharmaceutical compositions comprising the Clec9A binding agents (and/or any other therapeutic agents) described herein and a pharmaceutically acceptable carrier or excipient. In some embodiments, the present invention pertains to pharmaceutical compositions comprising the present Clec9A binding agents. In another embodiment, the present invention pertains to pharmaceutical compositions comprising any other therapeutic agents described herein. In a further embodiment, the present invention pertains to pharmaceutical compositions comprising a combination of the present Clec9A binding agents and any other therapeutic agents described herein. Any pharmaceutical compositions described herein can be administered to a subject as a component of a composition that comprises a pharmaceutically acceptable carrier or vehicle. Such compositions can optionally comprise a suitable amount of a pharmaceutically acceptable excipient so as to provide the form for proper administration.

In various embodiments, pharmaceutical excipients can be liquids, such as water and oils, including those of petroleum, animal, vegetable, or synthetic origin, such as peanut oil, soybean oil, mineral oil, sesame oil and the like. The pharmaceutical excipients can be, for example, saline, gum acacia, gelatin, starch paste, talc, keratin, colloidal silica, urea and the like. In addition, auxiliary, stabilizing, thickening, lubricating, and coloring agents can be used. In one embodiment, the pharmaceutically acceptable excipients are sterile when administered to a subject. Water is a useful excipient when any agent described herein is administered intravenously. Saline solutions and aqueous dextrose and glycerol solutions can also be employed as liquid excipients, specifically for injectable solutions. Suitable pharmaceutical excipients also include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. Any agent described herein, if desired, can also comprise minor amounts of wetting or emulsifying agents, or pH buffering agents. Other examples of suitable pharmaceutical excipients are described in *Remington's Pharmaceutical Sciences* 1447-1676 (Alfonso R. Gennaro eds., 19th ed. 1995), incorporated herein by reference.

The present invention includes the described pharmaceutical compositions (and/or additional therapeutic agents) in various formulations. Any inventive pharmaceutical composition (and/or additional therapeutic agents) described herein can take the form of solutions, suspensions, emulsion, drops, tablets, pills, pellets, capsules, capsules containing liquids, gelatin capsules, powders, sustained-release formulations, suppositories, emulsions, aerosols, sprays, suspensions, lyophilized powder, frozen suspension, desiccated powder, or any other form suitable for use. In one embodiment, the composition is in the form of a capsule. In another embodiment, the composition is in the form of a tablet. In yet another embodiment, the pharmaceutical composition is formulated in the form of a soft-gel capsule. In a further embodiment, the pharmaceutical composition is formulated in the form of a gelatin capsule. In yet another embodiment, the pharmaceutical composition is formulated as a liquid.

Where necessary, the inventive pharmaceutical compositions (and/or additional agents) can also include a solubilizing agent. Also, the agents can be delivered with a suitable vehicle or delivery device as known in the art. Combination therapies outlined herein can be co-delivered in a single delivery vehicle or delivery device.

The formulations comprising the inventive pharmaceutical compositions (and/or additional agents) of the present invention may conveniently be presented in unit dosage forms and may be prepared by any of the methods well known in the art of pharmacy. Such methods generally include the step of bringing the therapeutic agents into association with a carrier, which constitutes one or more accessory ingredients. Typically, the formulations are prepared by uniformly and intimately bringing the therapeutic agent into association with a liquid carrier, a finely divided solid carrier, or both, and then, if necessary, shaping the product into dosage forms of the desired formulation (e.g., wet or dry granulation, powder blends, etc., followed by tableting using conventional methods known in the art).

In various embodiments, any pharmaceutical compositions (and/or additional agents) described herein is formulated in accordance with routine procedures as a composition adapted for a mode of administration described herein.

Routes of administration include, for example: oral, intradermal, intramuscular, intraperitoneal, intravenous, subcutaneous, intranasal, epidural, sublingual, intranasal, intracerebral, intravaginal, transdermal, rectally, by inhalation, or topically. Administration can be local or systemic. In some embodiments, the administering is effected orally. In another embodiment, the administration is by parenteral injection. The mode of administration can be left to the discretion of the practitioner, and depends in-part upon the site of the medical condition. In most instances, administration results in the release of any agent described herein into the bloodstream.

In one embodiment, the Clec9A binding agent described herein is formulated in accordance with routine procedures as a composition adapted for oral administration. Compositions for oral delivery can be in the form of tablets, lozenges, aqueous or oily suspensions, granules, powders, emulsions, capsules, syrups, or elixirs, for example. Orally administered compositions can comprise one or more agents, for example, sweetening agents such as fructose, aspartame or saccharin; flavoring agents such as peppermint, oil of wintergreen, or cherry; coloring agents; and preserving agents, to provide a pharmaceutically palatable preparation. Moreover, where in tablet or pill form, the compositions can be coated to delay disintegration and absorption in the gastrointestinal tract thereby providing a sustained action over an extended period of time. Selectively permeable membranes surrounding an osmotically active driving any Clec9A binding agents described herein are also suitable for orally administered compositions. In these latter platforms, fluid from the environment surrounding the capsule is imbibed by the driving compound, which swells to displace the agent or agent composition through an aperture. These delivery platforms can provide an essentially zero order delivery profile as opposed to the spiked profiles of immediate release formulations. A time-delay material such as glycerol monostearate or glycerol stearate can also be useful. Oral compositions can include standard excipients such as mannitol, lactose, starch, magnesium stearate, sodium saccharin, cellulose, and magnesium carbonate. In one embodiment, the excipients are of pharmaceutical grade. Suspensions, in addition to the active compounds, may contain suspending agents such as, for example, ethoxylated isostearyl alcohols, polyoxyethylene sorbitol and sorbitan esters, microcrystalline cellulose, aluminum metahydroxide, bentonite, agar-agar, tragacanth, etc., and mixtures thereof.

Dosage forms suitable for parenteral administration (e.g. intravenous, intramuscular, intraperitoneal, subcutaneous and intra-articular injection and infusion) include, for example, solutions, suspensions, dispersions, emulsions, and the like. They may also be manufactured in the form of sterile solid compositions (e.g. lyophilized composition), which can be dissolved or suspended in sterile injectable medium immediately before use. They may contain, for example, suspending or dispersing agents known in the art. Formulation components suitable for parenteral administration include a sterile diluent such as water for injection, saline solution, fixed oils, polyethylene glycols, glycerine, propylene glycol or other synthetic solvents; antibacterial agents such as benzyl alcohol or methyl paraben; antioxidants such as ascorbic acid or sodium bisulfite; chelating agents such as EDTA; buffers such as acetates, citrates or phosphates; and agents for the adjustment of tonicity such as sodium chloride or dextrose.

For intravenous administration, suitable carriers include physiological saline, bacteriostatic water, Cremophor ELTM (BASF, Parsippany, NJ) or phosphate buffered saline (PBS). The carrier should be stable under the conditions of manufacture and storage, and should be preserved against microorganisms. The carrier can be a solvent or dispersion medium containing, for example, water, ethanol, polyol (for example, glycerol, propylene glycol, and liquid polyetheylene glycol), and suitable mixtures thereof.

The compositions provided herein, alone or in combination with other suitable components, can be made into aerosol formulations (i.e., "nebulized") to be administered via inhalation. Aerosol formulations can be placed into pressurized acceptable propellants, such as dichlorodifluoromethane, propane, nitrogen, and the like.

Any inventive pharmaceutical compositions (and/or additional agents) described herein can be administered by controlled-release or sustained-release means or by delivery devices that are well known to those of ordinary skill in the art. Examples include, but are not limited to, those described in U.S. Pat. Nos. 3,845,770; 3,916,899; 3,536,809; 3,598,123; 4,008,719; 5,674,533; 5,059,595; 5,591,767; 5,120,548; 5,073,543; 5,639,476; 5,354,556; and 5,733,556, each of which is incorporated herein by reference in its entirety. Such dosage forms can be useful for providing controlled- or sustained-release of one or more active ingredients using, for example, hydropropyl cellulose, hydropropylmethyl cellulose, polyvinylpyrrolidone, other polymer matrices, gels, permeable membranes, osmotic systems, multilayer coatings, microparticles, liposomes, microspheres, or a combination thereof to provide the desired release profile in varying proportions. Suitable controlled- or sustained-release formulations known to those skilled in the art, including those described herein, can be readily selected for use with the active ingredients of the agents described herein. The invention thus provides single unit dosage forms suitable for oral administration such as, but not limited to, tablets, capsules, gelcaps, and caplets that are adapted for controlled- or sustained-release.

Controlled- or sustained-release of an active ingredient can be stimulated by various conditions, including but not limited to, changes in pH, changes in temperature, stimulation by an appropriate wavelength of light, concentration or availability of enzymes, concentration or availability of water, or other physiological conditions or compounds.

In another embodiment, a controlled-release system can be placed in proximity of the target area to be treated, thus requiring only a fraction of the systemic dose (see, e.g., Goodson, in *Medical Applications of Controlled Release*, supra, vol. 2, pp. 115-138 (1984)). Other controlled-release systems discussed in the review by Langer, 1990, *Science* 249:1527-1533) may be used.

Pharmaceutical formulations preferably are sterile. Sterilization can be accomplished, for example, by filtration through sterile filtration membranes. Where the composition is lyophilized, filter sterilization can be conducted prior to or following lyophilization and reconstitution.

Administration and Dosage

It will be appreciated that the actual dose of the Clec9A binding agent and/or any therapeutic agents described herein to be administered according to the present invention will vary according to the particular dosage form, and the mode of administration. Many factors that may modify the action of the Clec9A binding agent (e.g., body weight, gender, diet, time of administration, route of administration, rate of excretion, condition of the subject, drug combinations, genetic disposition and reaction sensitivities) can be taken into account by those skilled in the art.

Administration can be carried out continuously or in one or more discrete doses within the maximum tolerated dose. Optimal administration rates for a given set of conditions can be ascertained by those skilled in the art using conventional dosage administration tests.

In some embodiments, a suitable dosage of the Clec9A binding agent and/or any therapeutic agents described herein is in a range of about 0.01 mg/kg to about 10 g/kg of body weight of the subject, about 0.01 mg/kg to about 1 g/kg of body weight of the subject, about 0.01 mg/kg to about 100 mg/kg of body weight of the subject, about 0.01 mg/kg to about 10 mg/kg of body weight of the subject, for example, about 0.01 mg/kg, about 0.02 mg/kg, about 0.03 mg/kg, about 0.04 mg/kg, about 0.05 mg/kg, about 0.06 mg/kg, about 0.07 mg/kg, about 0.08 mg/kg, about 0.09 mg/kg, about 0.1 mg/kg, about 0.2 mg/kg, about 0.3 mg/kg, about 0.4 mg/kg, about 0.5 mg/kg, about 0.6 mg/kg, about 0.7 mg/kg, about 0.8 mg/kg, about 0.9 mg/kg, about 1 mg/kg, about 1.1 mg/kg, about 1.2 mg/kg, about 1.3 mg/kg, about 1.4 mg/kg, about 1.5 mg/kg, about 1.6 mg/kg, about 1.7 mg/kg, about 1.8 mg/kg, 1.9 mg/kg, about 2 mg/kg, about 3 mg/kg, about 4 mg/kg, about 5 mg/kg, about 6 mg/kg, about 7 mg/kg, about 8 mg/kg, about 9 mg/kg, about 10 mg/kg body weight, about 100 mg/kg body weight, about 1 g/kg of body weight, about 10 g/kg of body weight, inclusive of all values and ranges therebetween.

Individual doses of the Clec9A binding agent and/or any therapeutic agents described herein can be administered in unit dosage forms containing, for example, from about 0.01 mg to about 100 g, from about 0.01 mg to about 75 g, from about 0.01 mg to about 50 g, from about 0.01 mg to about 25 g, about 0.01 mg to about 10 g, about 0.01 mg to about 7.5 g, about 0.01 mg to about 5 g, about 0.01 mg to about 2.5 g, about 0.01 mg to about 1 g, about 0.01 mg to about 100 mg, from about 0.1 mg to about 100 mg, from about 0.1 mg to about 90 mg, from about 0.1 mg to about 80 mg, from about 0.1 mg to about 70 mg, from about 0.1 mg to about 60 mg, from about 0.1 mg to about 50 mg, from about 0.1 mg to about 40 mg active ingredient, from about 0.1 mg to about 30 mg, from about 0.1 mg to about 20 mg, from about 0.1 mg to about 10 mg, from about 0.1 mg to about 5 mg, from about 0.1 mg to about 3 mg, from about 0.1 mg to about 1 mg per unit dosage form, or from about 5 mg to about 80 mg per unit dosage form. For example, a unit dosage form can be about 0.01 mg, about 0.02 mg, about 0.03 mg, about 0.04 mg, about 0.05 mg, about 0.06 mg, about 0.07 mg, about 0.08 mg, about 0.09 mg, about 0.1 mg, about 0.2 mg, about 0.3 mg, about 0.4 mg, about 0.5 mg, about 0.6 mg, about 0.7 mg, about 0.8 mg, about 0.9 mg, about 1 mg, about 2 mg, about 3 mg, about 4 mg, about 5 mg, about 6 mg, about 7 mg, about 8 mg, about 9 mg about 10 mg, about 15 mg, about 20 mg, about 25 mg, about 30 mg, about 35 mg, about 40 mg, about 45 mg, about 50 mg, about 55 mg, about 60 mg, about 65 mg, about 70 mg, about 75 mg, about 80 mg, about 85 mg, about 90 mg, about 95 mg, about 100 mg, about 200 mg, about 500 mg, about 1 g, about 2.5 g, about 5 g, about 10 g, about 25 g, about 50 g, about 75 g, about 100 g, inclusive of all values and ranges therebetween.

In one embodiment, the Clec9A binding agent and/or any therapeutic agents described herein are administered at an amount of from about 0.01 mg to about 100 g daily, from about 0.01 mg to about 75 g daily, from about 0.01 mg to about 50 g daily, from about 0.01 mg to about 25 g daily, from about 0.01 mg to about 10 g daily, from about 0.01 mg to about 7.5 g daily, from about 0.01 mg to about 5 g daily, from about 0.01 mg to about 2.5 g daily, from about 0.01 mg to about 1 g daily, from about 0.01 mg to about 100 mg daily, from about 0.1 mg to about 100 mg daily, from about 0.1 mg to about 95 mg daily, from about 0.1 mg to about 90 mg daily, from about 0.1 mg to about 85 mg daily, from about 0.1 mg to about 80 mg daily, from about 0.1 mg to about 75 mg daily, from about 0.1 mg to about 70 mg daily, from about 0.1 mg to about 65 mg daily, from about 0.1 mg to about 60 mg daily, from about 0.1 mg to about 55 mg daily, from about 0.1 mg to about 50 mg daily, from about 0.1 mg to about 45 mg daily, from about 0.1 mg to about 40 mg daily, from about 0.1 mg to about 35 mg daily, from about 0.1 mg to about 30 mg daily, from about 0.1 mg to about 25 mg daily, from about 0.1 mg to about 20 mg daily, from about 0.1 mg to about 15 mg daily, from about 0.1 mg to about 10 mg daily, from about 0.1 mg to about 5 mg daily, from about 0.1 mg to about 3 mg daily, from about 0.1 mg to about 1 mg daily, or from about 5 mg to about 80 mg daily. In various embodiments, the Clec9A binding agent is administered at a daily dose of about 0.01 mg, about 0.02 mg, about 0.03 mg, about 0.04 mg, about 0.05 mg, about 0.06 mg, about 0.07 mg, about 0.08 mg, about 0.09 mg, about 0.1 mg, about 0.2 mg, about 0.3 mg, about 0.4 mg, about 0.5 mg, about 0.6 mg, about 0.7 mg, about 0.8 mg, about 0.9 mg, about 1 mg, about 2 mg, about 3 mg, about 4 mg, about 5 mg, about 6 mg, about 7 mg, about 8 mg, about 9 mg about 10 mg, about 15 mg, about 20 mg, about 25 mg, about 30 mg, about 35 mg, about 40 mg, about 45 mg, about 50 mg, about 55 mg, about 60 mg, about 65 mg, about 70 mg, about 75 mg, about 80 mg, about 85 mg, about 90 mg, about 95 mg, about 100 mg, about 200 mg, about 500 mg, about 1 g, about 2.5 g, about 5 g, about 7.5 g, about 10 g, about 25 g, about 50 g, about 75 g, about 100 g, inclusive of all values and ranges therebetween.

In accordance with certain embodiments of the invention, the pharmaceutical composition comprising the Clec9A binding agent and/or any therapeutic agents described herein may be administered, for example, more than once daily (e.g., about two times, about three times, about four times, about five times, about six times, about seven times, about eight times, about nine times, or about ten times daily), about once per day, about every other day, about every third day, about once a week, about once every two weeks, about once every month, about once every two months, about once every three months, about once every six months, or about once every year.

Combination Therapy and Additional Therapeutic Agents

In various embodiments, the pharmaceutical composition of the present invention is co-administered in conjunction with additional therapeutic agent(s). Co-administration can be simultaneous or sequential.

In one embodiment, the additional therapeutic agent and the Clec9A binding agent of the present invention are administered to a subject simultaneously. The term "simultaneously" as used herein, means that the additional therapeutic agent and the Clec9A binding agent are administered with a time separation of no more than about 60 minutes, such as no more than about 30 minutes, no more than about 20 minutes, no more than about 10 minutes, no more than about 5 minutes, or no more than about 1 minute. Administration of the additional therapeutic agent and the Clec9A binding agent can be by simultaneous administration of a single formulation (e.g., a formulation comprising the additional therapeutic agent and the Clec9A binding agent) or of separate formulations (e.g., a first formulation including the additional therapeutic agent and a second formulation including the Clec9A binding agent).

Co-administration does not require the therapeutic agents to be administered simultaneously, if the timing of their administration is such that the pharmacological activities of the additional therapeutic agent and the Clec9A binding agent overlap in time, thereby exerting a combined therapeutic effect. For example, the additional therapeutic agent and the Clec9A binding agent can be administered sequentially. The term "sequentially" as used herein means that the additional therapeutic agent and the Clec9A binding agent are administered with a time separation of more than about 60 minutes. For example, the time between the sequential administration of the additional therapeutic agent and the Clec9A binding agent can be more than about 60 minutes, more than about 2 hours, more than about 5 hours, more than about 10 hours, more than about 1 day, more than about 2 days, more than about 3 days, more than about 1 week, or more than about 2 weeks, or more than about one month apart. The optimal administration times will depend on the rates of metabolism, excretion, and/or the pharmacodynamic activity of the additional therapeutic agent and the Clec9A binding agent being administered. Either the additional therapeutic agent or the Clec9A binding agent cell may be administered first.

Co-administration also does not require the therapeutic agents to be administered to the subject by the same route of administration. Rather, each therapeutic agent can be administered by any appropriate route, for example, parenterally or non-parenterally.

In some embodiments, the Clec9A binding agent described herein acts synergistically when co-administered with another therapeutic agent. In such embodiments, the Clec9A binding agent and the additional therapeutic agent may be administered at doses that are lower than the doses employed when the agents are used in the context of monotherapy.

In some embodiments, the present invention pertains to chemotherapeutic agents as additional therapeutic agents. For example, without limitation, such combination of the present Clec9A binding agents and chemotherapeutic agent find use in the treatment of cancers, as described elsewhere herein. Examples of chemotherapeutic agents include, but are not limited to, alkylating agents such as thiotepa and CYTOXAN® cyclophosphamide; alkyl sulfonates such as busulfan, improsulfan and piposulfan; aziridines such as benzodopa, carboquone, meturedopa, and uredopa; ethylenimines and methylamelamines including altretamine, triethylenemelamine, trietylenephosphoramide, triethiylenethiophosphoramide and trimethylolomelamine; acetogenins (e.g., bullatacin and bullatacinone); a camptothecin (including the synthetic analogue topotecan); bryostatin; callystatin; CC-1065 (including its adozelesin, carzelesin and bizelesin synthetic analogues); cryptophycins (e.g., cryptophycin 1 and cryptophycin 8); dolastatin; duocarmycin (including the synthetic analogues, KW-2189 and CB 1-TM1); eleutherobin; pancratistatin; a sarcodictyin; spongistatin; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, and ranimnustine; antibiotics such as the enediyne antibiotics (e.g., calicheamicin, especially calicheamicin gammaII and calicheamicin omegaII (see, e.g., Agnew, Chem. Intl. Ed. Engl., 33: 183-186 (1994)); dynemicin, including dynemicin A; bisphosphonates, such as clodronate; an esperamicin; as well as neocarzinostatin chromophore and related chromoprotein enediyne antibiotic chromophores), aclacinomysins, actinomycin, authramycin, azaserine, bleomycins, cactinomycin, carabicin, caminomycin, carzinophilin, chromomycinis, dactinomycin, daunorubicin, detorubicin, 6-diazo-5-oxo-L-norleucine, ADRIAMYCIN® doxorubicin (including morpholino-doxorubicin, cyanomorpholino-doxorubicin, 2-pyrrolino-doxorubicin and deoxy doxorubicin), epirubicin, esorubicin, idarubicin, marcellomycin, mitomycins such as mitomycin C, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as minoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; demecolcine; diaziquone; elformithine; elliptinium acetate; an epothilone; etoglucid; gallium nitrate; hydroxyurea; lentinan; lonidainine; maytansinoids such as maytansine and ansamitocins; mitoguazone; mitoxantrone; mopidanmol; nitraerine; pentostatin; phenamet; pirarubicin; losoxantrone; podophyllinic acid; 2-ethylhydrazide; procarbazine; PSK polysaccharide complex (JHS Natural Products, Eugene, Oreg.); razoxane; rhizoxin; sizofuran; spirogermanium; tenuazonic acid; triaziquone; 2,2',2"-trichlorotriethylamine; trichothecenes (e.g., T-2 toxin, verracurin A, roridin A and anguidine); urethan; vindesine; dacarbazine; mannomustine; mitobronitol; mitolactol; pipobroman; gacytosine; arabinoside ("Ara-C"); cyclophosphamide; thiotepa; taxoids, e.g., TAXOL paclitaxel (Bristol-Myers Squibb Oncology, Princeton, N.J.), ABRAXANE® Cremophor-free, albumin-engineered nanoparticle formulation of paclitaxel (American Pharmaceutical Partners, Schaumberg, 111.), and TAXOTERE® doxetaxel (Rhone-Poulenc Rorer, Antony, France); chloranbucil; GEMZAR® gemcitabine; 6-thioguanine; mercaptopurine; methotrexate; platinum analogs such as cisplatin, oxaliplatin and carboplatin; vinblastine; platinum; etoposide (VP-16); ifosfamide; mitoxantrone; vincristine; NAVELBINE®. vinorelbine; novantrone; teniposide; edatrexate; daunomycin; aminopterin; xeloda; ibandronate; irinotecan (Camptosar, CPT-11) (including the treatment regimen of irinotecan with 5-FU and leucovorin); topoisomerase inhibitor RFS 2000; difluoromethylornithine (DMFO); retinoids such as retinoic acid; capecitabine; combretastatin; leucovorin (LV); oxaliplatin, including the oxaliplatin treatment regimen (FOLFOX®); lapatinib (Tykerb®); inhibitors of PKC-α, Raf, H-Ras, EGFR (e.g., erlotinib (Tarceva®)) and VEGF-A that reduce cell proliferation and pharmaceutically acceptable salts, acids or derivatives of any of the above. In addition, the methods of treatment can further include the use of radiation. In addition, the methods of treatment can further include the use of photodynamic therapy.

Accordingly, in some embodiments, the present invention relates to combination therapies using the Clec9A binding agent and a chemotherapeutic agent. In some embodiments, the present invention relates to administration of the Clec9A binding agent to a patient undergoing treatment with a chemotherapeutic agent. In some embodiments, the chemotherapeutic agent is a DNA-intercalating agent such as, without limitation, doxorubicin, cisplatin, daunorubicin, and epirubicin. In an embodiment, the DNA-intercalating agent is doxorubicin.

In illustrative embodiments, the Clec9A binding agent acts synergistically when co-administered with doxorubicin.

In an illustrative embodiment, the Clec9A binding agent acts synergistically when co-administered with doxorubicin for use in treating tumor or cancer. For example, co-administration of the Clec9A binding agent and doxorubicin may act synergistically to reduce or eliminate the tumor or cancer, or slow the growth and/or progression and/or metastasis of the tumor or cancer. In illustrative embodiments, the combination of the Clec9A binding agent and doxorubicin may exhibit improved safety profiles when compared to the agents used alone in the context of monotherapy. In illustrative embodiments, the Clec9A binding agent and doxorubicin may be administered at doses that are lower than the doses employed when the agents are used in the context of monotherapy. In some embodiments, the Clec9A binding agent comprises a mutated interferon such as a mutated IFNα. In illustrative embodiments, the mutated IFNα comprises one or more mutations at positions 148, 149, and 153 with reference to SEQ ID NO: 337 or SEQ ID NO: 338, such as the substitutions M148A, R149A, and L153A.

In some embodiments, the present invention relates to combination therapy with one or more immune-modulating agents, for example, without limitation, agents that modulate immune checkpoint. In various embodiments, the immune-modulating agent targets one or more of PD-1, PD-L1, and PD-L2. In various embodiments, the immune-modulating agent is PD-1 inhibitor. In various embodiments, the immune-modulating agent is an antibody specific for one or more of PD-1, PD-L1, and PD-L2. For instance, in some embodiments, the immune-modulating agent is an antibody such as, by way of non-limitation, nivolumab, (ONO-4538/BMS-936558, MDX1106, OPDIVO®, BRISTOL MYERS SQUIBB), pembrolizumab (KEYTRUDA®, MERCK), pidilizumab (CT-011, CURE TECH), MK-3475 (MERCK), BMS 936559 (BRISTOL MYERS SQUIBB), MPDL3280A (ROCHE). In some embodiments, the immune-modulating agent targets one or more of CD137 or CD137L. In various embodiments, the immune-modulating agent is an antibody specific for one or more of CD137 or CD137L. For instance, in some embodiments, the immune-modulating agent is an antibody such as, by way of non-limitation, urelumab (also known as BMS-663513 and anti-4-1BB antibody). In some embodiments, the present chimeric protein is combined with urelumab (optionally with one or more of nivolumab, lirilumab, and urelumab) for the treatment of solid tumors and/or B-cell non-Hodgkins lymphoma and/or head and neck cancer and/or multiple myeloma. In some embodiments, the immune-modulating agent is an agent that targets one or more of CTLA-4, AP2M1, CD80, CD86, SHP-2, and PPP2R5A. In various embodiments, the immune-modulating agent is an antibody specific for one or more of CTLA-4, AP2M1, CD80, CD86, SHP-2, and PPP2R5A. For instance, in some embodiments, the immune-modulating agent is an antibody such as, by way of non-limitation, ipilimumab (MDX-010, MDX-101, Yervoy®, BMS) and/or tremelimumab (Pfizer). In some embodiments, the present chimeric protein is combined with ipilimumab (optionally with bavituximab) for the treatment of one or more of melanoma, prostate cancer, and lung cancer. In various embodiments, the immune-modulating agent targets CD20. In various embodiments, the immune-modulating agent is an antibody specific CD20. For instance, in some embodiments, the immune-modulating agent is an antibody such as, by way of non-limitation, Ofatumumab (GENMAB®), obinutuzumab (GAZYVA®), AME-133v (APPLIED MOLECULAR EVOLUTION), Ocrelizumab (GENENTECH), TRU-015 (TRUBION/EMERGENT), veltuzumab (IMMU-106).

In some embodiments, the present invention relates to combination therapy using the Clec9A binding agent and a checkpoint inhibitor. In some embodiments, the present invention relates to administration of the Clec9A binding agent to a patient undergoing treatment with a checkpoint inhibitor. In some embodiments, the checkpoint inhibitor is an agent that targets one or more of PD-1, PD-L1, PD-L2, and CTLA-4 (including any of the anti-PD-1, anti-PD-L1, anti-PD-L2, and anti-CTLA-4 agents described herein). In some embodiment, the checkpoint inhibitor is one or more of nivolumab, (ONO-4538/BMS-936558, MDX1106, OPDIVO®, BRISTOL MYERS SQUIBB), pembrolizumab (KEYTRUDA®, MERCK), pidilizumab (CT-011, CURE TECH), MK-3475 (MERCK), BMS 936559 (BRISTOL MYERS SQUIBB), MPDL3280A (ROCHE), ipilimumab (MDX-010, MDX-101, Yervoy®, BMS) and tremelimumab (Pfizer). In an embodiment, the checkpoint inhibitor is an antibody against PD-L1.

In illustrative embodiments, the Clec9A binding agent acts synergistically when co-administered with the anti-PD-L1 antibody. In an illustrative embodiment, the Clec9A binding agent acts synergistically when co-administered with the anti-PD-L1 antibody for use in treating tumor or cancer. For example, co-administration of the Clec9A binding agent and the anti-PD-L1 antibody may act synergistically to reduce or eliminate the tumor or cancer, or slow the growth and/or progression and/or metastasis of the tumor or cancer. In some embodiments, the combination of the Clec9A binding agent and the anti-PD-L1 antibody may exhibit improved safety profiles when compared to the agents used alone in the context of monotherapy. In some embodiments, the Clec9A binding agent and the anti-PD-L1 antibody may be administered at doses that are lower than the doses employed when the agents are used in the context of monotherapy. In some embodiments, the Clec9A binding agent comprises a mutated interferon such as a mutated IFNα. In illustrative embodiments, the mutated IFNα comprises one or more mutations at positions 148, 149, and 153 with reference to SEQ ID NO: 337 or SEQ ID NO: 338, such as the substitutions M148A, R149A, and L153A.

In some embodiments, the present invention relates to combination therapies using the Clec9A binding agent and an immunosuppressive agent. In some embodiments, the present invention relates to administration of the Clec9A binding agent to a patient undergoing treatment with an immunosuppressive agent. In an embodiment, the immunosuppressive agent is TNF.

In illustrative embodiments, the Clec9A binding agent acts synergistically when co-administered with TNF. In an illustrative embodiment, the Clec9A binding agent acts synergistically when co-administered with TNF for use in treating tumor or cancer. For example, co-administration of the Clec9A binding agent and TNF may act synergistically to reduce or eliminate the tumor or cancer, or slow the growth and/or progression and/or metastasis of the tumor or cancer. In some embodiments, the combination of the Clec9A binding agent and TNF may exhibit improved safety profiles when compared to the agents used alone in the context of monotherapy. In some embodiments, the Clec9A binding agent and TNF may be administered at doses that are lower than the doses employed when the agents are used in the context of monotherapy. In some embodiments, the Clec9A binding agent comprises a mutated interferon such as a mutated IFNα. In illustrative embodiments, the mutated IFNα comprises one or more mutations at positions 148, 149, and 153 with reference to SEQ ID NO: 337 or SEQ ID NO: 338, such as the substitutions M148A, R149A, and L153A.

In some embodiments, the Clec9A binding agent acts synergistically when used in combination with Chimeric Antigen Receptor (CAR) T-cell therapy. In an illustrative embodiment, the Clec9A binding agent acts synergistically when used in combination with CAR T-cell therapy in treating tumor or cancer. In an embodiment, the Clec9A binding agent acts synergistically when used in combination with CAR T-cell therapy in treating blood-based tumors. In an embodiment, the Clec9A binding agent acts synergistically when used in combination with CAR T-cell therapy in treating solid tumors. For example, use of the Clec9A binding agent and CAR T-cells may act synergistically to reduce or eliminate the tumor or cancer, or slow the growth and/or progression and/or metastasis of the tumor or cancer. In various embodiments, the Clec9A binding agent of the invention induces CAR T-cell division. In various embodiments, the Clec9A binding agent of the invention induces CAR T-cell proliferation. In various embodiments, the Clec9A binding agent of the invention prevents anergy of the CAR T cells.

In various embodiments, the CAR T-cell therapy comprises CAR T cells that target antigens (e.g., tumor antigens) such as, but not limited to, carbonic anhydrase IX (CAIX), 5T4, CD19, CD20, CD22, CD30, CD33, CD38, CD47, CS1, CD138, Lewis-Y, L1-CAM, MUC16, ROR-1, IL13Rα2, gp100, prostate stem cell antigen (PSCA), prostate-specific membrane antigen (PSMA), B-cell maturation antigen (BCMA), human papillomavirus type 16 E6 (HPV-16 E6), CD171, folate receptor alpha (FR-α), GD2, human epidermal growth factor receptor 2 (HER2), mesothelin, EGFRvIII, fibroblast activation protein (FAP), carcinoembryonic antigen (CEA), and vascular endothelial growth factor receptor 2 (VEGF-R2), as well as other tumor antigens well known in the art. Additional illustrative tumor antigens include, but are not limited to MART-1/Melan-A, gp100, Dipeptidyl peptidase IV (DPPIV), adenosine deaminase-binding protein (ADAbp), cyclophilin b, Colorectal associated antigen (CRC)-0017-1A/GA733, Carcinoembryonic Antigen (CEA) and its immunogenic epitopes CAP-1 and CAP-2, etv6, aml1, Prostate Specific Antigen (PSA) and its immunogenic epitopes PSA-1, PSA-2, and PSA-3, T-cell receptor/CD3-zeta chain, MAGE-family of tumor antigens (e.g., MAGE-A1, MAGE-A2, MAGE-A3, MAGE-A4, MAGE-A5, MAGE-A6, MAGE-A7, MAGE-A8, MAGE-A9, MAGE-A10, MAGE-A11, MAGE-A12, MAGE-Xp2 (MAGE-B2), MAGE-Xp3 (MAGE-B3), MAGE-Xp4 (MAGE-B4), MAGE-C1, MAGE-C2, MAGE-C3, MAGE-C4, MAGE-C5), GAGE-family of tumor antigens (e.g., GAGE-1, GAGE-2, GAGE-3, GAGE-4, GAGE-5, GAGE-6, GAGE-7, GAGE-8, GAGE-9), BAGE, RAGE, LAGE-1, NAG, GnT-V, MUM-1, CDK4, tyrosinase, p53, MUC family, HER2/neu, p21ras, RCAS1, α-fetoprotein, E-cadherin, α-catenin, β-catenin and γ-catenin, p120ctn, gp100 Pmel117, PRAME, NY-ESO-1, cdc27, adenomatous polyposis coli protein (APC), fodrin, Connexin 37, Ig-idiotype, p15, gp75, GM2 and GD2 gangliosides, viral products such as human papilloma virus proteins, Smad family of tumor antigens, Imp-1, NA, EBV-encoded nuclear antigen (EBNA)-1, brain glycogen phosphorylase, SSX-1, SSX-2 (HOM-MEL-40), SSX-1, SSX-4, SSX-5, SCP-1 CT-7, c-erbB-2, CD19, CD37, CD56, CD70, CD74, CD138, AGS16, MUC1, GPNMB, Ep-CAM, PD-L1, and PD-L2.

Exemplary CAR T-cell therapy include, but are not limited to, JCAR014 (Juno Therapeutics), JCAR015 (Juno Therapeutics), JCAR017 (Juno Therapeutics), JCAR018 (Juno Therapeutics), JCAR020 (Juno Therapeutics), JCAR023 (Juno Therapeutics), JCAR024 (Juno Therapeutics), CTLO19 (Novartis), KTE-C19 (Kite Pharma), BPX-401 (Bellicum Pharmaceuticals), BPX-501 (Bellicum Pharmaceuticals), BPX-601 (Bellicum Pharmaceuticals), bb2121 (Bluebird Bio), CD-19 Sleeping Beauty cells (Ziopharm Oncology), UCART19 (Cellectis), UCART123 (Cellectis), UCART38 (Cellectis), UCARTCS1 (Cellectis), OXB-302 (Oxford BioMedica, MB-101 (Mustang Bio) and CAR T-cells developed by Innovative Cellular Therapeutics.

In some embodiments, the Clec9A binding agent is used in a method of treating multiple sclerosis (MS) in combination with one or more MS therapeutics including, but not limited to, 3-interferons, L acetate, T-interferon, IFN-β-2 (U.S. Patent Publication No. 2002/0025304), spirogermaniums (e.g., N-(3-dimethylaminopropyl)-2-aza-8,8-dimethyl-8-germanspiro [4:5] decane, N-(3-dimethylaminopropyl)-2-aza-8,8-diethyl-8-germaspiro [4:5]decane, N-(3-dimethylaminopropyl)-2-aza-8,8-dipropyl-8-germaspiro [4:5] decane, and N-(3-dimethylaminopropyl)-2-aza-8,8-dibutyl-8-germaspiro [4:5] decane), vitamin D analogs (e.g., 1,25 (OH) 2D3, (see, e.g., U.S. Pat. No. 5,716,946)), prostaglandins (e.g., latanoprost, brimonidine, PGE1, PGE2 and PGE3, see, e.g., U.S. Patent Publication No. 2002/0004525), tetracycline and derivatives (e.g., minocycline and doxycycline, see, e.g., U.S. Patent Publication No. 20020022608), a VLA-4 binding antibody (see, e.g., U.S. Patent Publication No. 2009/0202527), adrenocorticotrophic hormone, corticosteroid, prednisone, methylprednisone, 2-chlorodeoxyadenosine, mitoxantrone, sulphasalazine, methotrexate, azathioprine, cyclophosphamide, cyclosporin, fumarate, anti-CD20 antibody (e.g., rituximab), and tizanidine hydrochloride.

In some embodiments, the Clec9A binding agent is used in combination with one or more therapeutic agents that treat one or more symptoms or side effects of MS. Such agents include, but are not limited to, amantadine, baclofen, papaverine, meclizine, hydroxyzine, sulfamethoxazole, ciprofloxacin, docusate, pemoline, dantrolene, desmopressin, dexamethasone, tolterodine, phenyloin, oxybutynin, bisacodyl, venlafaxine, amitriptyline, methenamine, clonazepam, isoniazid, vardenafil, nitrofurantoin, psyllium hydrophilic mucilloid, alprostadil, gabapentin, nortriptyline, paroxetine, propantheline bromide, modafinil, fluoxetine, phenazopyridine, methylprednisolone, carbamazepine, imipramine, diazepam, sildenafil, bupropion, and sertraline.

In some embodiments, the Clec9A binding agent is used in a method of treating multiple sclerosis in combination with one or more of the disease modifying therapies (DMTs) described herein (e.g. the agents of Table A). In some embodiments, the present invention provides an improved therapeutic effect as compared to use of one or more of the DMTs described herein (e.g. the agents listed in the Table A below) without the one or more disclosed binding agent. In an embodiment, the combination of the Clec9A binding agent and the one or more DMTs

TABLE A

| Generic Name | Branded Name/Company | Frequency/Route of Delivery/Usual Dose |
|---|---|---|
| | Illustrative Disease Modifying Therapies | |
| teriflunomide | AUBAGIO ® (GENZYME) | Every day; pill taken orally; 7 mg or 14 mg. |
| interferon beta-1a | AVONEX ® (BIOGEN IDEC) | Once a week; intramuscular (into the muscle) injection; 30 mcg |
| interferon beta-1b | BETASERON ® (BAYER HEALTHCARE PHARMACEUTICALS, INC.) | Every other day; subcutaneous (under the skin) injection; 250 mcg. |
| glatiramer acetate | COPAXONE ® (TEVA NEUROSCIENCE) | Every day; subcutaneous (under the skin) injection; 20 mg (20,000 mcg) OR Three times a week; subcutaneous (under the skin) injection; 40 mg (40,000 mcg) |
| interferon beta-1b | EXTAVIA ® (NOVARTIS PHARMACEUTICALS CORP.) | Every other day; subcutaneous (under the skin) injection; 250 mcg. |
| fingolimod | GILENYA ® (NOVARTIS PHARMACEUTICALS CORP.) | Every day; capsule taken orally; 0.5 mg. |
| Alemtuzumab (anti-CD52 monoclonal antibody) | LEMTRADA ® (GENZYME) | Intravenous infusion on five consecutive days, followed by intravenous infusion on three consecutive days one year later (12 mg) |
| mitoxantrone | NOVANTRONE ® (EMD SERONO) | Four times a year by IV infusion in a medical facility. Lifetime cumulative dose limit of approximately 8-12 doses over 2-3 years (140 mg/m2). |
| pegylated interferon beta-1a | PLEGRIDY ® (BIOGEN IDEC) | Every 14 days; subcutaneous (under the skin) injection; 125 mcg |
| interferon beta-1a | REBIF ® (EMD SERONO, INC.) | Three times a week; subcutaneous (under the skin) injection; 44 mcg |
| dimethyl fumarate (BG-12) | TECFIDERA ® (BIOGEN IDEC) | Twice a day; capsule taken orally; 120 mg for one week and 240 mg therafter |
| Natalizumab (humanized monoclonal antibody VLA-4 antagonist) | TYSABRI ® (BIOGEN IDEC) | Every four weeks by IV infusion in a registered infusion facility; 300 mg |
| | DMTs in Development | |
| Amiloride (targets Acid-sensing ion channel-1 Epithelial sodium channel Na+/H+ exchanger) | PAR PHARMACEUTICAL, PERRIGO COMPANY, SIGMAPHARM LABORATORIES | Oral |
| ATX-MS-1467 (targets Major histocompatibility complex class II T cell responses to myelin basic protein) | APITOPE/MERCK SERONO | Intradermal Subcutaneous |
| BAF312 (targets Sphingosine 1-phosphate (S1P) receptor subtypes S1P1 and S1P5 B cell distrubution T cell distribution) | NOVARTIS PHARMA | Oral |
| BGC20-0134 (targets Proinflammatory and anti-inflammatory cytokines) | BTG PLC | Oral |
| BIIB033 (targets LINGO-1 ("leucine-rich repeat and immunoglobulin-like domain-containing, Nogo receptor-interacting protein")) | BIOGEN | Intravenous infusion used in Phase I and Phase II trials Subcutaneous injection used in Phase I trial |
| Cladribine (targets CD4+ T cells DNA synthesis and repair E-selectin Intracellular adhesion molecule-1 Pro-inflammatory cytokines interleukin 2 and interleukin 2R Pro-inflammatory cytokines interleukin 8 and RANTES Cytokine secretion Monocyte and lymphocyte migration) | MERCK SERONO | Oral |
| Cyclophosphamide (targets T cells, particularly CD4+ helper T cells B cells) | BAXTER HEALTHCARE CORPORATION | Oral, monthly intravenous pulses |
| Daclizumab (humanized monoclonal antibody targeting CD25 Immune modulator of T cells) | BIOGEN IDEC/ABBVIE BIOTHERAPEUTICS | Projected to be IM injection once monthly |
| Dalfampridine (targets Voltage-gated potassium channels Degenerin/epithelial sodium | ACORDA THERAPEUTICS/ BIOGEN IDEC | One tablet every 12 hours (extended release), 10 mg twice a day |

TABLE A-continued

Illustrative Disease Modifying Therapies

| Generic Name | Branded Name/Company | Frequency/Route of Delivery/Usual Dose |
|---|---|---|
| channels L-type calcium channels that contain subunit Cavbeta3) | | |
| Dronabinol (targets Cannabinoid receptor CB1 Cannabinoid receptor CB2) | ABBVIE INC. | Oral |
| Firategrast (targets Alpha4beta1 integrin) | GLAXOSMITHKLINE | Oral |
| GNbAC1MSRV-Env (targets envelope protein of the MS-associated retrovirus) | GENEURO SA/SERVIER | Intravenous infusion |
| Idebenone (targets Reactive oxygen species) | SANTHERA PHARMACEUTICALS | Oral Dose in clinical trial for PPMS is 2250 mg per day (750 mg dose, 3 times per day) |
| Imilecleucel-T (targets Myelin-specific, autoreactive T cells) | OPEXA THERAPEUTICS/ MERCK SERONO | Subcutaneous Given 5 times per year, according to information from the manufacturer |
| Laquinimod | TEVA | Projected to be 0.6 mg or 1.2 mg oral tablet taken daily |
| Masitinib (targets KIT (a stem cell factor, also called c-KIT) receptor as well as select other tyrosine kinases Mast cells) | AB SCIENCE | Oral |
| MEDI-551 (targets CD19, a B cell-specific antigen that is part of the B cell receptor complex and that functions in determining the threshold for B cell activation B cells Plasmablasts, B cells that express CD19 (but not CD20) and that secrete large quantities of antibodies; depletion of plasmablasts may be useful in autoimmune diseases involving pathogenic autoantibodies) | MEDIMMUNE | Intravenous Subcutaneous |
| Minocycline (targets T cells Microglia Leukocyte migration Matrix metalloproteinases) | VARIOUS | Oral Available as pellet-filled capsules and an oral suspension |
| MIS416 (targets Innate immune system Pathogen-associated molecular pattern recognition receptors of the innate immune system Myeloid cells of the innate immune system, which might be able to remodel the deregulated immune system activity that occurs in SPMS) | INNATE IMMUNOTHERAPEUTICS | Intravenous |
| Mycophenolate mofetil (targets Purine synthesis) | MANUFACTURED BY GENENTECH | Oral |
| Naltrexone (targets Opioid receptors Toll-like receptor 4) | VARIOUS | Given at low doses (3 to 4.5 mg per day) in oral form as "Low-dose naltrexone" (or "LDN") |
| Ocrelizumab and Ofatumumab (humanized monoclonal antibodies targeting CD20 B cell suppression | ROCHE/GSK | Projected to be IV infusion |
| ONO-4641 (targets Sphingosine 1-phosphate receptor) | ONO PHARMACEUTICAL CO. | Oral |
| Phenytoin (targets Sodium channels) | PFIZER | Intravenous Intramuscular (less favored option) Oral |
| Ponesimod | ACTELION | To be determined |
| Raltegravir (targets Retroviral integrase Herpesvirus DNA packaging terminase) | MERCK | Oral 400 mg tablet twice daily, according to information from the manufacturer |
| RHB-104 | REDHILL BIOPHARMA LIMITED | 95 mg clarithromycin, 45 mg rifabutin, and 10 mg clofazimine |
| Riluzole (targets Glutamatergic | COVIS PHARMA/SANOFI | Oral |

| Generic Name | Branded Name/Company | Frequency/Route of Delivery/Usual Dose |
|---|---|---|
| neurotransmission Glutamate uptake and release Voltage-gated sodium channels Protein kinase C) | | |

MS disease progression may be most intensive, and most damaging, at the earliest stages of disease progression. Accordingly, counter to many reimbursement policies and physician practice in light of, for example, costs and side effect mitigation, it may be most beneficial for a patient's long term disease status to begin treatment with the most intensive DMTs, for instance so-called second-line therapies. In some embodiments, a patient is treated with a regimen of the Clec9A binding agent in combination with a second-line therapy. Such a combination is used to reduce the side effect profile of one or more second-line therapies. In some embodiments, the combination is used to reduce dose of frequency of administration of one or more second-line therapies. For example, the doses of agents listed in Table A provided above may be reduced by about 50%, or about 40%, or about 30%, or about 25% in the context of the combination and the/or the frequency of dosing may be decreased to be half as often, or a third as often or may be reduced from, for example, daily to every other day or weekly, every other day to weekly or bi-weekly, weekly to bi-weekly or monthly, etc. Accordingly, in some embodiments, the Clec9A binding agent increase patient adherence by allowing for more convenient treatment regimens. Further, some DMTs have a suggested lifetime dose limitation e.g. for mitoxantrone, the lifetime cumulative dose should be strictly limited to 140 mg/m$^2$, or 2 to 3 years of therapy. In some embodiments, supplementation with the Clec9A binding agent preserves patient's access to mitoxantrone by allowing for lower or less frequent dosing with this DMT.

In some embodiments, the patient is a naive patient, who has not received treatment with one or more DMTs, and the Clec9A binding agent is used to buffer the side effects of a second-line therapy. Accordingly, the naive patient is able to benefit from the long-term benefits of a second-line therapy at disease outset. In some embodiments, the Clec9A binding agent is used as an entry therapy that precedes the use of a second-line therapy. For example, the Clec9A binding agent may be administered for an initial treatment period of about 3 months to stabilize disease and then the patient may be transitioned to a maintenance therapy of a second line agent.

It is generally believed that naive patients are more likely to respond to therapy as compared to patients that have received, and perhaps failed one or more DMT. In some embodiments, the Clec9a binding agent finds use in patients that have received, and perhaps failed one or more DMT. For example, in some embodiments, the Clec9A binding agent increases the therapeutic effect in patients that have received, and perhaps failed one or more DMT and may allow these patients to respond like naive patients.

In some embodiments, the patient has received or is receiving treatment with one or more DMTs and is not responding well. For example, the patient may be refractory or poorly responsive to one or more DMTs. In some embodiments, the patient is refractory, or poorly responsive to one or more of teriflunomide (AUBAGIO® (GENZYME)); interferon beta-1a (AVONEX® (BIOGEN IDEC); interferon beta-1b (BETASERON® (BAYER HEALTHCARE PHARMACEUTICALS, INC.); glatiramer acetate (CO-PAXONE® (TEVA NEUROSCIENCE); interferon beta-1b (EXTAVIA® (NOVARTIS PHARMACEUTICALS CORP.); fingolimod (GILENYA® (NOVARTIS PHARMACEUTICALS CORP.); alemtuzumab (LEMTRADA® (GENZYME); mitoxantrone (NOVANTRONE® (EMD SERONO); pegylated interferon beta-1a (PLEGRIDY® (BIOGEN IDEC); interferon beta-1a (REBIF® (EMD SERONO, INC.); dimethyl fumarate (BG-12) (TECFIDERA® (BIOGEN IDEC); and natalizumab (TYSABRI® (BIOGEN IDEC). In some embodiments, the one or more disclosed binding agent results in a therapeutic benefit of one or more DMTs in the patient and therefore reduces or eliminates the non-responsiveness to the DMT. For instance, this may spare the patient therapy with one or more DMTs at a higher dosing or frequency.

In patients with more aggressive disease, one approach is an induction treatment model, where a therapy with strong efficacy but strong safety concerns would be given first, followed by a maintenance therapy. An example of such a model might include initial treatment with alemtuzumab, followed by IFN-β, GA, or BG-12. In some embodiments, the one or more disclosed binding agent is used to prevent the need to switch therapies for maintenance. In some embodiments, the one or more disclosed binding agent is used to as maintenance therapy to one or more DMTs, including second line therapies. In some embodiments, the one or more disclosed binding agent is used to as first therapy in an induction, followed by another DMT as a maintenance therapy—such as, for example, a first line therapy.

In some embodiments, the one or more disclosed binding agent may be administered for an initial treatment period of about 3 months to stabilize disease and then the patient may be transitioned to a maintenance therapy of a first line agent.

In various embodiments, the one or more disclosed binding agent is used to reduce one or more side effects of a DMT, including without limitation any agent disclosed herein. For example, the one or more disclosed binding agent may be used in a regimen that allows dose sparing for one or more DMTs and therefore results in fewer side effects. For example, in some embodiments, the one or more disclosed binding agent may reduce one or more side effects of AUBAGIO® or related agents, which may include hair thinning, diarrhea, flu, nausea, abnormal liver tests and unusual numbness or tingling in the hands or feet (paresthesias), levels of white blood cells, which can increase the risk of infections; increase in blood pressure; and severe liver damage. In some embodiments, the one or more disclosed binding agent may reduce one or more side effects of AVONEX® or related agents which include flu-like symptoms following injection, depression, mild anemia, liver abnormalities, allergic reactions, and heart problems. In some embodiments, the one or more disclosed binding agent may reduce one or more side effects of BETASERON® or related agents which include flu-like symptoms following injection, injection site reactions, allergic reactions, depression, liver abnormalities, and low white blood cell counts. In some embodiments, the one or more disclosed binding agent may reduce one or more side effects of COPAXONE® or related agents which include injection site reactions, vasodilation (dilation of blood vessels); chest pain; a reaction immediately after injection, which includes anxiety, chest pain, palpitations, shortness of breath, and flushing. In some embodiments, the one or more disclosed binding agent may reduce one or more side effects of EXTAVIA® or related agents which include flu-like symptoms following injection, injection site reactions, allergic reactions, depression, liver abnormalities, and low white blood cell counts. In some embodiments, the one or more disclosed binding agent may reduce one or more side effects of GILENYA® or related agents which include headache, flu, diarrhea, back pain, liver enzyme elevations, cough, slowed heart rate following first dose, infections, and swelling in the eye. In some embodiments, the one or more disclosed binding agent may reduce one or more side effects of LEMTRADA® or related agents which include rash, headache, fever, nasal congestion, nausea, urinary tract infection, fatigue, insomnia, upper respiratory tract infection, hives, itching, thyroid gland disorders, fungal Infection, pain in joints, extremities and back, diarrhea, vomiting, flushing, and infusion reactions (including nausea, hives, itching, insomnia, chills, flushing, fatigue, shortness of breath, changes in the sense of taste, indigestion, dizziness, pain). In some embodiments, the one or more disclosed binding agent may reduce one or more side effects of NOVANTRONE® or related agents which include blue-green urine 24 hours after administration; infections, bone marrow suppression (fatigue, bruising, low blood cell counts), nausea, hair thinning, bladder infections, mouth sores, and serious liver and heart damage. In some embodiments, the one or more disclosed binding agent may reduce one or more side effects of PLEGRIDY® or related agents which include flu-like symptoms following injection, injection site reactions, depression, mild anemia, liver abnormalities, allergic reactions, and heart problems. In some embodiments, the one or more disclosed binding agent may reduce one or more side effects of REBIF® or related agents which include flu-like symptoms following injection, injection site reactions, liver abnormalities, depression, allergic reactions, and low red or white blood cell counts. In some embodiments, one or more disclosed binding agent may reduce one or more side effects of TECFIDERA® or related agents which include flushing (sensation of heat or itching and a blush on the skin), gastrointestinal issues (nausea, diarrhea, abdominal pain), rash, protein in the urine, elevated liver enzymes; and reduction in blood lymphocyte (white blood cell) counts. In some embodiments, the one or more disclosed binding agent may reduce one or more side effects of TYSABRI® or related agents which include headache, fatigue, urinary tract infections, depression, respiratory tract infections, joint pain, upset stomach, abdominal discomfort, diarrhea, vaginitis, pain in the arms or legs, rash, allergic or hypersensitivity reactions within two hours of infusion (dizziness, fever, rash, itching, nausea, flushing, low blood pressure, difficulty breathing, chest pain).

In some embodiments, the present invention relates to combination therapy with one or more chimeric agents described in WO 2013/10779, WO 2015/007536, WO 2015/007520, WO 2015/007542, and WO 2015/007903, the entire contents of which are hereby incorporated by reference in their entireties.

In some embodiments, inclusive of, without limitation, infectious disease applications, the present invention pertains to anti-infectives as additional therapeutic agents. In some embodiments, the anti-infective is an anti-viral agent including, but not limited to, Abacavir, Acyclovir, Adefovir, Amprenavir, Atazanavir, Cidofovir, Darunavir, Delavirdine, Didanosine, Docosanol, Efavirenz, Elvitegravir, Emtricitabine, Enfuvirtide, Etravirine, Famciclovir, and Foscarnet. In some embodiments, the anti-infective is an anti-bacterial agent including, but not limited to, cephalosporin antibiotics (cephalexin, cefuroxime, cefadroxil, cefazolin, cephalothin, cefaclor, cefamandole, cefoxitin, cefprozil, and ceftobiprole); fluoroquinolone antibiotics (cipro, Levaquin, floxin, tequin, avelox, and norflox); tetracycline antibiotics (tetracycline, minocycline, oxytetracycline, and doxycycline); penicillin antibiotics (amoxicillin, ampicillin, penicillin V, dicloxacillin, carbenicillin, vancomycin, and methicillin); monobactam antibiotics (aztreonam); and carbapenem antibiotics (ertapenem, doripenem, imipenem/cilastatin, and meropenem). In some embodiments, the anti-infectives include anti-malarial agents (e.g., chloroquine, quinine, mefloquine, primaquine, doxycycline, artemether/lumefantrine, atovaquone/proguanil and sulfadoxine/pyrimethamine), metronidazole, tinidazole, ivermectin, pyrantel pamoate, and albendazole.

In some embodiments, inclusive, without limitation, of autoimmmune applications, the additional therapeutic agent is an immunosuppressive agent. In some embodiments, the immunosuppressive agent is an anti-inflammatory agent such as a steroidal anti-inflammatory agent or a non-steroidal anti-inflammatory agent (NSAID). Steroids, particularly the adrenal corticosteroids and their synthetic analogues, are well known in the art. Examples of corticosteroids useful in the present invention include, without limitation, hydroxyltriamcinolone, alpha-methyl dexamethasone, beta-methyl betamethasone, beclomethasone dipropionate, betamethasone benzoate, betamethasone dipropionate, betamethasone valerate, clobetasol valerate, desonide, desoxymethasone, dexamethasone, diflorasone diacetate, diflucortolone valerate, fluadrenolone, fluclorolone acetonide, flumethasone pivalate, fluosinolone acetonide, fluocinonide, flucortine butylester, fluocortolone, fluprednidene (fluprednylidene) acetate, flurandrenolone, halcinonide, hydrocortisone acetate, hydrocortisone butyrate, methylprednisolone, triamcinolone acetonide, cortisone, cortodoxone, flucetonide, fludrocortisone, difluorosone diacetate, fluradrenolone acetonide, medrysone, amcinafel, amcinafide, betamethasone and the balance of its esters, chloroprednisone, clocortelone, clescinolone, dichlorisone, difluprednate, flucloronide, flunisolide, fluoromethalone, fluperolone, fluprednisolone, hydrocortisone, meprednisone, paramethasone, prednisolone, prednisone, beclomethasone dipropionate. (NSAIDS) that may be used in the present invention, include but are not limited to, salicylic acid, acetyl salicylic acid, methyl salicylate, glycol salicylate, salicylmides, benzyl-2,5-diacetoxybenzoic acid, ibuprofen, fulindac, naproxen, ketoprofen, etofenamate, phenylbutazone, and indomethacin. In some embodiments, the immunosupressive agent may be cytostatics such as alkylating agents, antimetabolites (e.g., azathioprine, methotrexate), cytotoxic antibiotics, antibodies (e.g., basiliximab, daclizumab, and muromonab), anti-immunophilins (e.g., cyclosporine, tacrolimus, sirolimus), inteferons, opioids, TNF binding proteins, mycophenolates, and small biological agents (e.g., fingolimod, myriocin). Additional anti-inflammatory agents are described, for example, in U.S. Pat. No. 4,537,776, the entire contents of which is incorporated by reference herein.

In some embodiments, the Clec9A binding agent described herein, include derivatives that are modified, i.e., by the covalent attachment of any type of molecule to the composition such that covalent attachment does not prevent the activity of the composition. For example, but not by way of limitation, derivatives include composition that have been modified by, inter alia, glycosylation, lipidation, acetylation, pegylation, phosphorylation, amidation, derivatization by known protecting/blocking groups, proteolytic cleavage, linkage to a cellular ligand or other protein, etc. Any of numerous chemical modifications can be carried out by known techniques, including, but not limited to specific chemical cleavage, acetylation, formylation, metabolic synthesis of tunicamycin, etc.

In still other embodiments, the Clec9A binding agent described herein further comprise a cytotoxic agent, comprising, in illustrative embodiments, a toxin, a chemotherapeutic agent, a radioisotope, and an agent that causes apoptosis or cell death. Such agents may be conjugated to a composition described herein.

The Clec9A binding agent described herein may thus be modified post-translationally to add effector moieties such as chemical linkers, detectable moieties such as for example fluorescent dyes, enzymes, substrates, bioluminescent materials, radioactive materials, and chemiluminescent moieties, or functional moieties such as for example streptavidin, avidin, biotin, a cytotoxin, a cytotoxic agent, and radioactive materials.

Illustrative cytotoxic agents include, but are not limited to, methotrexate, aminopterin, 6-mercaptopurine, 6-thioguanine, cytarabine, 5-fluorouracil decarbazine; alkylating agents such as mechlorethamine, thioepa chlorambucil, melphalan, carmustine (BSNU), mitomycin C, lomustine (CCNU), 1-methylnitrosourea, cyclothosphamide, mechlorethamine, busulfan, dibromomannitol, streptozotocin, mitomycin C, cis-dichlorodiamine platinum (II) (DDP) cisplatin and carboplatin (paraplatin); anthracyclines include daunorubicin (formerly daunomycin), doxorubicin (adriamycin), detorubicin, carminomycin, idarubicin, epirubicin, mitoxantrone and bisantrene; antibiotics include dactinomycin (actinomycin D), bleomycin, calicheamicin, mithramycin, and anthramycin (AMC); and antimytotic agents such as the vinca alkaloids, vincristine and vinblastine. Other cytotoxic agents include paclitaxel (taxol), ricin, pseudomonas exotoxin, gemcitabine, cytochalasin B, gramicidin D, ethidium bromide, emetine, etoposide, tenoposide, colchicin, dihydroxy anthracin dione, 1-dehydrotestosterone, glucocorticoids, procaine, tetracaine, lidocaine, propranolol, puromycin, procarbazine, hydroxyurea, asparaginase, corticosteroids, mytotane (O,P'-(DDD)), interferons, and mixtures of these cytotoxic agents.

Further cytotoxic agents include, but are not limited to, chemotherapeutic agents such as carboplatin, cisplatin, paclitaxel, gemcitabine, calicheamicin, doxorubicin, 5-fluorouracil, mitomycin C, actinomycin D, cyclophosphamide, vincristine, bleomycin, VEGF antagonists, EGFR antagonists, platins, taxols, irinotecan, 5-fluorouracil, gemcytabine, leucovorine, steroids, cyclophosphamide, melphalan, vinca alkaloids (e.g., vinblastine, vincristine, vindesine and vinorelbine), mustines, tyrosine kinase inhibitors, radiotherapy, sex hormone antagonists, selective androgen receptor modulators, selective estrogen receptor modulators, PDGF antagonists, TNF antagonists, IL-1 antagonists, interleukins (e.g. IL-12 or IL-2), IL-12R antagonists, Toxin conjugated monoclonal antibodies, tumor antigen specific monoclonal antibodies, Erbitux, Avastin, Pertuzumab, anti-CD20 antibodies, Rituxan, ocrelizumab, ofatumumab, DXL625, HERCEPTIN®, or any combination thereof. Toxic enzymes from plants and bacteria such as ricin, diphtheria toxin and *Pseudomonas* toxin may be conjugated to the therapeutic agents (e.g. antibodies) to generate cell-type-specific-killing reagents (Youle, et al., Proc. Nat'l Acad. Sci. USA 77:5483 (1980); Gilliland, et al., Proc. Nat'l Acad. Sci. USA 77:4539 (1980); Krolick, et al., Proc. Nat'l Acad. Sci. USA 77:5419 (1980)).

Other cytotoxic agents include cytotoxic ribonucleases as described by Goldenberg in U.S. Pat. No. 6,653,104. Embodiments of the invention also relate to radioimmunoconjugates where a radionuclide that emits alpha or beta particles is stably coupled to the Clec9A binding agent, with or without the use of a complex-forming agent. Such radionuclides include beta-emitters such as Phosphorus-32, Scandium-47, Copper-67, Gallium-67, Yttrium-88, Yttrium-90, Iodine-125, Iodine-131, Samarium-153, Lutetium-177, Rhenium-186 or Rhenium-188, and alpha-emitters such as Astatine-211, Lead-212, Bismuth-212, Bismuth-213 or Actinium-225.

Illustrative detectable moieties further include, but are not limited to, horseradish peroxidase, acetylcholinesterase, alkaline phosphatase, beta-galactosidase and luciferase. Further illustrative fluorescent materials include, but are not limited to, rhodamine, fluorescein, fluorescein isothiocyanate, umbelliferone, dichlorotriazinylamine, phycoerythrin and dansyl chloride. Further illustrative chemiluminescent moieties include, but are not limited to, luminol. Further illustrative bioluminescent materials include, but are not limited to, luciferin and aequorin. Further illustrative radioactive materials include, but are not limited to, Iodine-125, Carbon-14, Sulfur-35, Tritium and Phosphorus-32.

Methods of Treatment

Methods and compositions described herein have application to treating various diseases and disorders, including, but not limited to cancer, infections, immune disorders, and inflammatory diseases or conditions.

Further, any of the present agents may be for use in the treating, or the manufacture of a medicament for treating, various diseases and disorders, including, but not limited to cancer, infections, immune disorders, inflammatory diseases or conditions, and autoimmune diseases.

In some embodiments, the present invention relates to the treatment of, or a patient having cancer. As used herein, cancer refers to any uncontrolled growth of cells that may interfere with the normal functioning of the bodily organs and systems, and includes both primary and metastatic tumors. Primary tumors or cancers that migrate from their original location and seed vital organs can eventually lead to the death of the subject through the functional deterioration of the affected organs. A metastasis is a cancer cell or group of cancer cells, distinct from the primary tumor location, resulting from the dissemination of cancer cells from the primary tumor to other parts of the body. Metastases may eventually result in death of a subject. For example, cancers can include benign and malignant cancers, polyps, hyperplasia, as well as dormant tumors or micrometastases.

Illustrative cancers that may be treated include, but are not limited to, basal cell carcinoma, biliary tract cancer; bladder cancer; bone cancer; brain and central nervous system cancer; breast cancer; cancer of the peritoneum; cervical cancer; choriocarcinoma; colon and rectum cancer; connective tissue cancer; cancer of the digestive system; endometrial cancer; esophageal cancer; eye cancer; cancer of the head and neck; gastric cancer (including gastrointestinal cancer); glioblastoma; hepatic carcinoma; hepatoma; intraepithelial neoplasm; kidney or renal cancer; larynx cancer; leukemia; liver cancer; lung cancer (e.g., small-cell lung cancer, non-small cell lung cancer, adenocarcinoma of the lung, and squamous carcinoma of the lung); melanoma; myeloma; neuroblastoma; oral cavity cancer (lip, tongue, mouth, and pharynx); ovarian cancer; pancreatic cancer; prostate cancer; retinoblastoma; rhabdomyosarcoma; rectal cancer; cancer of the respiratory system; salivary gland carcinoma; sarcoma; skin cancer; squamous cell cancer; stomach cancer; testicular cancer; thyroid cancer; uterine or endometrial cancer; cancer of the urinary system; vulval cancer; lymphoma including Hodgkin's and non-Hodgkin's lymphoma, as well as B-cell lymphoma (including low grade/follicular non-Hodgkin's lymphoma (NHL); small lymphocytic (SL) NHL; intermediate grade/follicular NHL; intermediate grade diffuse NHL; high grade immunoblastic NHL; high grade lymphoblastic NHL; high grade small non-cleaved cell NHL; bulky disease NHL; mantle cell lymphoma; AIDS-related lymphoma; and Waldenstrom's Macroglobulinemia; chronic lymphocytic leukemia (CLL); acute lymphoblastic leukemia (ALL); acute myeloid leukemia (AML); Hairy cell leukemia; chronic myeloblastic leukemia; as well as other carcinomas and sarcomas; and post-transplant lymphoproliferative disorder (PTLD), as well as abnormal vascular proliferation associated with phakomatoses, edema (e.g. that associated with brain tumors), and Meigs' syndrome.

In various embodiments, the present invention provides Clec9A binding agents which are part of a chimera that further comprises modified signaling agents for the treatment of cancer. In some embodiments, the Clec9A binding agents of the invention significantly reduce and/or eliminate tumors. In some embodiments, the present Clec9A binding agents significant reduce and/or eliminate tumors when administered to a subject in combination with other anti-cancer agents such as chemotherapeutic agents, checkpoint inhibitors, and immunosuppressive agents. In various embodiments, the combination of Clec9A binding agents and other anti-cancer agents synergistically reduced tumor size and/or eliminated tumor cells.

In various embodiments, the present invention relates to cancer combination therapies with a Clec9A binding agent that is part of a chimera comprising one or more targeting moieties and one or more modified signaling agents. Accordingly, the present invention provides for chimeric or fusion proteins that include, for example, a targeting moiety against Clec9A and one or more signaling agents and uses thereof in combination with anti-cancer agents.

For instance, in various embodiments, the present invention pertains to combination therapies for cancer involving chimeras of a Clec9A binding agent described herein and a modified signaling agent, including, without limitation a mutated human interferon, such as IFN alpha, including human interferon alpha 2.

In other embodiments, the present Clec9A binding agent is part of a chimera that comprises multiple targeting moieties and therefore be present in bispecific or trispecific formats. For instance, in various embodiments, the present invention pertains to combination therapies for cancer involving chimeras of a Clec9A binding agent and a checkpoint inhibitor binding agent (e.g. anti-PD-L1, anti-PD-1, anti-PD-L2, or anti-CTLA) described herein and a modified signaling agent, including, without limitation a mutated human interferon, such as IFN alpha, including human interferon alpha 2.

In various embodiments, the signaling agent is modified to have reduced affinity or activity for one or more of its receptors, which allows for attenuation of activity (inclusive of agonism or antagonism) and/or prevents non-specific signaling or undesirable sequestration of the chimeric protein. In some embodiments, the reduced affinity or activity at the receptor is restorable by attachment with one or more of the targeting moieties described herein.

In some embodiments, the present invention relates to the treatment of, or a patient having a microbial infection and/or chronic infection. Illustrative infections include, but are not limited to, HIV/AIDS, tuberculosis, osteomyelitis, hepatitis B, hepatitis C, Epstein-Barr virus or parvovirus, T cell leukemia virus, bacterial overgrowth syndrome, fungal or parasitic infections.

In various embodiments, the present compositions are used to treat or prevent one or more inflammatory diseases or conditions, such as inflammation, acute inflammation, chronic inflammation, respiratory disease, atherosclerosis, restenosis, asthma, allergic rhinitis, atopic dermatitis, septic shock, rheumatoid arthritis, inflammatory bowel disease, inflammatory pelvic disease, pain, ocular inflammatory disease, celiac disease, Leigh Syndrome, Glycerol Kinase Deficiency, Familial eosinophilia (FE), autosomal recessive spastic ataxia, laryngeal inflammatory disease; Tuberculosis, Chronic cholecystitis, Bronchiectasis, Silicosis and other pneumoconioses.

In various embodiments, the present invention has application to treating autoimmune and/or neurodegenerative diseases.

In various embodiments, the present compositions are used to treat or prevent one or more conditions characterized by undesirable CTL activity, and/or a conditions characterized by high levels of cell death. For instance, in various embodiments, the present compositions are used to treat or prevent one or more conditions associated with uncontrolled or overactive immune response.

In various embodiments, the present compositions are used to treat or prevent one or more autoimmune and/or neurodegenerative diseases or conditions, such as MS, diabetes mellitus, lupus, celiac disease, Crohn's disease, ulcerative colitis, Guillain-Barre syndrome, scleroderms, Goodpasture's syndrome, Wegener's granulomatosis, autoimmune epilepsy, Rasmussen's encephalitis, Primary biliary sclerosis, Sclerosing cholangitis, Autoimmune hepatitis, Addison's disease, Hashimoto's thyroiditis, Fibromyalgia, Menier's syndrome; transplantation rejection (e.g., prevention of allograft rejection) pernicious anemia, rheumatoid arthritis, systemic lupus erythematosus, dermatomyositis, Sjogren's syndrome, lupus erythematosus, myasthenia gravis, Reiter's syndrome, Grave's disease, and other autoimmune diseases.

In various embodiments, the present invention is used to treat or prevent various autoimmune and/or neurodegenerative diseases. In some embodiments, the autoimmune and/or neurodegenerative diseases selected from MS (including without limitation the subtypes described herein), Alzheimer's disease (including, without limitation, Early-onset Alzheimer's, Late-onset Alzheimer's, and Familial Alzheimer's disease (FAD), Parkinson's disease and parkinsonism (including, without limitation, Idiopathic Parkinson's disease, Vascular parkinsonism, Drug-induced parkinsonism, Dementia with Lewy bodies, Inherited Parkinson's, Juvenile Parkinson's), Huntington's disease, Amyotrophic lateral sclerosis (ALS, including, without limitation, Sporadic ALS, Familial ALS, Western Pacific ALS, Juvenile ALS, Hiramaya Disease).

In various embodiments, the present invention is used to treat or prevent MS. In various embodiments, the Clec9a binding agents as described herein are used to eliminate and reduce multiple MS symptoms. Illustrative symptoms associated with multiple sclerosis, which can be prevented or treated with the compositions and methods described herein, include: optic neuritis, diplopia, nystagmus, ocular dysmetria, internuclear ophthalmoplegia, movement and sound phosphenes, afferent pupillary defect, paresis, monoparesis, paraparesis, hemiparesis, quadraparesis, plegia, paraplegia, hemiplegia, tetraplegia, quadraplegia, spasticity, dysarthria, muscle atrophy, spasms, cramps, hypotonia, clonus, myoclonus, myokymia, restless leg syndrome, footdrop, dysfunctional reflexes, paraesthesia, anaesthesia, neuralgia, neuropathic and neurogenic pain, l'hermitte's sign, proprioceptive dysfunction, trigeminal neuralgia, ataxia, intention tremor, dysmetria, vestibular ataxia, vertigo, speech ataxia, dystonia, dysdiadochokinesia, frequent micturation, bladder spasticity, flaccid bladder, detrusor-sphincter dyssynergia, erectile dysfunction, anorgasmy, frigidity, constipation, fecal urgency, fecal incontinence, depression, cognitive dysfunction, dementia, mood swings, emotional lability, euphoria, bipolar syndrome, anxiety, aphasia, dysphasia, fatigue, Uhthoff's symptom, gastroesophageal reflux, and sleeping disorders. Mitigation or amelioration or one more of these symptoms in a subject can be achieved by the one or more agent as described herein.

In various embodiments, the Clec9A binding agents as described herein is used to treat or prevent clinically isolated syndrome (CIS). A clinically isolated syndrome (CIS) is a single monosymptomatic attack compatible with MS, such as optic neuritis, brain stem symptoms, and partial myelitis. Patients with CIS that experience a second clinical attack are generally considered to have clinically definite multiple sclerosis (CDMS). Over 80 percent of patients with CIS and MRI lesions go on to develop MS, while approximately 20 percent have a self-limited process. Patients who experience a single clinical attack consistent with MS may have at least one lesion consistent with multiple sclerosis prior to the development of clinically definite multiple sclerosis. In various embodiments, the presently described Clec9a binding agents is used to treat CIS so it does not develop into MS, including, for example RRMS.

In various embodiments, the Clec9A binding agents as described herein are used to treat or prevent radiologically isolated syndrome (RIS). In RIS, incidental imaging findings suggest inflammatory demyelination in the absence of clinical signs or symptoms. In various embodiments, the Clec9A binding agent is used to treat RIS so it does not develop into MS, including, for example RRMS.

In various embodiments, the Clec9A binding agents as described herein are used to treat one or more of benign multiple sclerosis; relapsing-remitting multiple sclerosis (RRMS); secondary progressive multiple sclerosis (SPMS); progressive relapsing multiple sclerosis (PRMS); and primary progressive multiple sclerosis (PPMS).

Benign multiple sclerosis is a retrospective diagnosis which is characterized by 1-2 exacerbations with complete recovery, no lasting disability and no disease progression for 10-15 years after the initial onset. Benign multiple sclerosis may, however, progress into other forms of multiple sclerosis. In various embodiments, the Clec9a binding agent is used to treat benign multiple sclerosis so it does not develop into MS.

Patients suffering from RRMS experience sporadic exacerbations or relapses, as well as periods of remission. Lesions and evidence of axonal loss may or may not be visible on MRI for patients with RRMS. In various embodiments, the Clec9a binding agents as described herein are used to treat RRMS. In some embodiments, RRMS includes patients with RRMS; patients with SPMS and superimposed relapses; and patients with CIS who show lesion dissemination on subsequent MRI scans according to McDonald's criteria. A clinical relapse, which may also be used herein as "relapse," "confirmed relapse," or "clinically defined relapse," is the appearance of one or more new neurological abnormalities or the reappearance of one or more previously observed neurological abnormalities. This change in clinical state must last at least 48 hours and be immediately preceded by a relatively stable or improving neurological state of at least 30 days. In some embodiments, an event is counted as a relapse when the subject's symptoms are accompanied by observed objective neurological changes, consistent with an increase of at least 1.00 in the Expanded Disability Status Scale (EDSS) score or one grade in the score of two or more of the seven FS or two grades in the score of one of FS as compared to the previous evaluation.

SPMS may evolve from RRMS. Patients afflicted with SPMS have relapses, a diminishing degree of recovery during remissions, less frequent remissions and more pronounced neurological deficits than RRMS patients. Enlarged ventricles, which are markers for atrophy of the corpus callosum, midline center and spinal cord, are visible on MRI of patients with SPMS. In various embodiments, the Clec9a binding agents as described herein is used to treat RRMS so it does not develop into SPMS.

PPMS is characterized by a steady progression of increasing neurological deficits without distinct attacks or remissions. Cerebral lesions, diffuse spinal cord damage and evidence of axonal loss are evident on the MRI of patients with PPMS. PPMS has periods of acute exacerbations while proceeding along a course of increasing neurological deficits without remissions. Lesions are evident on MRI of patients suffering from PRMS. In various embodiments, the Clec9A binding agent as described herein is used to treat RRMS and/or SPMS so it does not develop into PPMS.

In some embodiments, the Clec9A binding agents as described herein are used in a method of treatment of relapsing forms of MS. In some embodiments, the Clec9A binding agent is used in a method of treatment of relapsing forms of MS to slow the accumulation of physical disability and/or reduce the frequency of clinical exacerbations, and, optionally, for patients who have experienced a first clinical episode and have MRI features consistent with MS. In some embodiments, the Clec9a binding agents as described herein are used in a method of treatment of worsening relapsing-remitting MS, progressive-relapsing MS or secondary-progressive MS to reduce neurologic disability and/or the frequency of clinical exacerbations. In some embodiments, the Clec9A binding agents reduce the frequency and/or severity of relapses.

In some embodiments, the Clec9A binding agents are used in a method of treatment of relapsing forms of MS in patients who have had an inadequate response to (or are refractory to) one, or two, or three, or four, or five, or six, or seven, or eight, or nine, or ten or more disease modifying therapies (DMTs).

In various embodiments, the subject's symptoms may be assessed quantitatively, such as by EDSS, or decrease in the frequency of relapses, or increase in the time to sustained progression, or improvement in the magnetic resonance imaging (MRI) behavior in frequent, serial MRI studies and compare the patient's status measurement before and after treatment. In a successful treatment, the patient status will have improved (e.g., the EDSS measurement number or frequency of relapses will have decreased, or the time to sustained progression will have increased, or the MRI scans will show less pathology).

In some embodiments, the patient can be evaluated, e.g., before, during or after receiving the Clec9a binding agents e.g., for indicia of responsiveness. Various clinical or other indicia of effectiveness of treatment, e.g., EDSS score; MRI scan; relapse number, rate, or severity; multiple sclerosis functional composite (MSFC); multiple sclerosis quality of life inventory (MSQLI); Paced Serial Addition Test (PASAT); symbol digit modalities test (SDMT); 25-foot walk test; 9-hole peg test; low contrast visual acuity; Modified Fatigue Impact Scale; expanded disability status score (EDSS); multiple sclerosis functional composite (MSFC); Beck Depression Inventory; and 7/24 Spatial Recall Test can be used. In various embodiments, the Clec9A binding agents cause an improvement in one or more of these measures. Further, the patient can be monitored at various times during a regimen. In some embodiments, the Clec9a binding agents cause a disease improvement as assessed by MacDonald dissemination in space and time. For example, for dissemination in space, lesion imaging, such as, by way of illustration, Barkhof-Tintore MR imaging criteria, may be used, including at least one gadolinium-enhancing lesion or 9 T2 hyperintense lesions; at least one infratentorial lesion; at least one juxtacortical lesion; at least about three periventricular lesions; and a spinal cord lesion. For dissemination in time, MRI can also be used; for example, if an MRI scan of the brain performed at >3 months after an initial clinical event demonstrates a new gadolinium-enhancing lesion, this may indicate a new CNS inflammatory event, because the duration of gadolinium enhancement in MS is usually less than 6 weeks. If there are no gadolinium-enhancing lesions but a new T2 lesion (presuming an MRI at the time of the initial event), a repeat MR imaging scan after another 3 months may be needed with demonstration of a new T2 lesion or gadolinium-enhancing lesion.

In some embodiments, disease effects are assessed using any of the measures described in Lavery, et al. Multiple Sclerosis International, Vol 2014 (2014), Article ID 262350, the entire contents of which are hereby incorporated by reference.

In some embodiments, the Clec9A binding agent results in one or more of: (a) prevention of worsening in disability defined as deterioration by 1.0 point on EDSS, (b) increase in time to relapse, (c) reduction or stabilization of number and/or volume of gadolinium enhancing lesions, (d) decreased annualized relapse rate, (e) increased relapse duration and severity by NRS score, (f) decrease in disease activity as measured by MRI (annual rate of new or enlarging lesions), (g) lower average number of relapses at 1 year, or 2 years, (h) sustained disease progression as measured by the EDSS at 3 months, (i) prevention of conversion to CDMS, (j) no or few new or enhancing T2 lesions, (k) minimal change in hyperintense T2 lesion volume, (l) increased time to McDonald defined MS, (m) prevention of progression of disability as measured by sustained worsening of EDSS at 12 weeks, (n) reduction in time to relapse at 96 weeks, and (o) reduction or stabilization of brain atrophy (e.g. percentage change from baseline).

In one embodiment, the Clec9A binding agents are administered and is effective to result in a decreased rate of relapse (e.g., at least 10%, 20%, 30%, 40%, 50%, 60%, 70%, 80% or greater reduction in rate of relapse) compared to the rate of relapse before administration (e.g., compared to the rate of relapse following administration for 12 months or for less than 12 months, e.g., about 10, or about 8, or about 4, or about 2 or less months) of treatment, or before commencement of treatment, when measured between 3-24 months (e.g., between 6-18 months, e.g., 12 months) after a previous relapse.

In one embodiment, the Clec9A binding agents are administered and are effective to result in a prevention of an increase in EDSS score from a pre-treatment state. The Kurtzke Expanded Disability Status Scale (EDSS) is a method of quantifying disability in multiple sclerosis. The EDSS replaced the previous Disability Status Scales which used to bunch people with MS in the lower brackets. The EDSS quantifies disability in eight Functional Systems (FS) and allows neurologists to assign a Functional System Score (FSS) in each of these. The Functional Systems are: pyramidal, cerebellar, brainstem, sensory, bowel and bladder, visual and cerebral.

In one embodiment, the Clec9A binding agents are administered and is effective to result in a decreased EDSS score (e.g., a decrease of 1, 1.5, 2, 2.5, 3 points or more, e.g., over at least three months, six months, one year, or longer) compared to the EDSS score following administration of the Clec9a binding agents (e.g. for 12 months or for less than 12 months, e.g., less than 10, 8, 4 or less months, or before the commencement of treatment).

In one embodiment, the Clec9A binding agents are administered and is effective to result in a decreased number of new lesions overall or of any one type (e.g., at least 10%, 20%, 30%, 40% decrease), compared to the number of new lesions following administration of the Clec9A binding agents for 12 months or for less than 12 months, e.g., less than 10, 8, 4 or less months, or before commencement of treatment;

In one embodiment, the Clec9A binding agents are administered and is effective to result in a decreased number of lesions overall or of any one type (e.g., at least 10%, 20%, 30%, 40% decrease), compared to the number of lesions following administration of the Clec9a binding agents for 12 months or for less than 12 months, e.g., less than 10, 8, 4 or less months, or before commencement of treatment;

In one embodiment, the Clec9A binding agents are administered and is effective to result in a reduced rate of appearance of new lesions overall or of any one type (e.g., at least 10%, 20%, 30%, 40% reduced rate), compared to the rate of appearance of new lesions following administration for 12 months or for less than 12 months, e.g., less than 10, 8, 4 or less months, or before commencement of treatment;

In one embodiment, the Clec9A binding agents are administered and is effective to result in a reduced increase in lesion area overall or of any one type (e.g., at least 10%, 20%, 30%, 40% decreased increase), compared to an increase in lesion area following administration for 12 months or less than 12 months, e.g., less than 10, 8, 4 or less months, or before commencement of treatment.

In one embodiment, the Clec9A binding agents are administered and is effective to result in a reduced incidence or symptom of optic neuritis (e.g., improved vision), compared to the incidence or symptom of optic neuritis following administration for 12 months or for less than 12 months, e.g., less than 10, 8, 4 or less months, or before commencement of treatment.

In various embodiments, methods of the invention are useful in treatment a human subject. In some embodiments, the human is a pediatric human. In other embodiments, the human is an adult human. In other embodiments, the human is a geriatric human. In other embodiments, the human may be referred to as a patient. In some embodiments, the human is a female. In some embodiments, the human is a male.

In certain embodiments, the human has an age in a range of from about 1 to about 18 months old, from about 18 to about 36 months old, from about 1 to about 5 years old, from about 5 to about 10 years old, from about 10 to about 15 years old, from about 15 to about 20 years old, from about 20 to about 25 years old, from about 25 to about 30 years old, from about 30 to about 35 years old, from about 35 to about 40 years old, from about 40 to about 45 years old, from about 45 to about 50 years old, from about 50 to about 55 years old, from about 55 to about 60 years old, from about 60 to about 65 years old, from about 65 to about 70 years old, from about 70 to about 75 years old, from about 75 to about 80 years old, from about 80 to about 85 years old, from about 85 to about 90 years old, from about 90 to about 95 years old or from about 95 to about 100 years old. In various embodiments, the human has an age of more than 30 years old.

Immune Modulation

In various embodiments, the present compositions are capable of, or find use in methods of, immune modulation. For instance, in various embodiments, the present methods of treatment may involve the immune modulation described herein. In some embodiments, the immune modulation involves IFN signaling, including modified IFN signaling, in the context of a dendritic cell (DC).

In various embodiments, a multi-specific Clec9a binding agent is provided. In some embodiments, such multi-specific Clec9a binding agent of the invention recognizes and binds to Clec9A and one or more antigens found on one or more immune cells, which can include, without limitation, megakaryocytes, thrombocytes, erythrocytes, mast cells, basophils, neutrophils, eosinophils, monocytes, macrophages, natural killer cells, T lymphocytes (e.g., cytotoxic T lymphocytes, T helper cells, natural killer T cells), B lymphocytes, plasma cells, dendritic cells, or subsets thereof. In some embodiments, the Clec9A binding agent specifically binds to an antigen of interest and effectively directly or indirectly recruits one of more immune cells.

In some embodiments, the Clec9a binding agent specifically binds to an antigen of interest and effectively directly or indirectly recruits one of more immune cells to cause an immunosuppressive effect, e.g. the Clec9a binding agent directly or indirectly recruits an immunosuppressive immune cell. In some embodiments, the immunosuppressive immune cell is a regulatory T cell (or "Tregs" which, as used herein, refers to a subpopulation of T cells which modulate the immune system, abrogate autoimmune disease, maintain tolerance to self-antigens and thwart anti-tumor immune responses). Other immunosuppressive immune cells include myeloid suppressor cells (or "MSC," which, as used herein, refers to a heterogeneous population of cells, defined by their myeloid origin, immature state, and ability to potently suppress T cell responses); tumor associated neutrophils (or "TANs" which, as used herein, refers to a subset of neutrophils that are capable of suppressing immune responses); tumor associated macrophages (or "TAMs" which, as used herein, refers to a subset of macrophages that may reduce an immune response), M2 macrophages, and/or tumor-inducing mast cells (which as used herein, refers to a subset of bone marrow-derived, long-lived, heterogeneous cellular population). Also, immunosuppressive immune cells include Th2 cells and Th17 cells. Additionally, immunosuppressive immune cells include immune cells, e.g., CD4+ and/or CD8+ T cells, expressing one or more checkpoint inhibitory receptors (e.g. receptors, including CTLA-4, B7-H3, B7-H4, TIM-3, expressed on immune cells that prevent or inhibit uncontrolled immune responses). See Stagg, J. et. al., Immunotherapeutic approach in triple-negative breast cancer. Ther Adv Med Oncol. (2013) 5(3):169-181).

In some embodiments, the Clec9a binding agent stimulates regulatory T cell (Treg) proliferation. Treg cells are characterized by the expression of the Foxp3 (Forkhead box p3) transcription factor. Most Treg cells are CD4+ and CD25+, and can be regarded as a subset of helper T cells, although a small population may be CD8+. Thus the immune response which is to be modulated by a method of the invention may comprise inducing proliferation of Treg cells, optionally in response to an antigen. Thus the method may comprise administering to the subject a composition comprising the antigen, wherein the antigen is associated with a binding agent having affinity for Clec9A. The antigen may be administered with an adjuvant which promotes proliferation of Treg cells.

Insofar as this method involves stimulating proliferation and differentiation of Treg cells in response to a specific antigen, it can be considered to be a method of stimulating an immune response. However, given that Treg cells may be capable of modulating the response of other cells of the immune system against an antigen in other ways, e.g. inhibiting or suppressing their activity, the effect on the immune system as a whole may be to modulate (e.g. suppress or inhibit) the response against that antigen. Thus the methods of this aspect of the invention can equally be referred to as methods of modulating (e.g. inhibiting or suppressing) an immune response against an antigen.

In some embodiments, the methods therapeutically or prophylactically inhibit or suppress an undesirable immune response against a particular antigen, even in a subject with pre-existing immunity or an on-going immune response to that antigen. This may be particularly useful, for example, in the treatment of autoimmune disease.

Under certain conditions, it may also be possible to tolerize a subject against a particular antigen by targeting the antigen to an antigen presenting cell expressing Clec9A. The invention thus provides a method for inducing tolerance in a subject towards an antigen, comprising administering to the subject a composition comprising the antigen, wherein the antigen is associated with a binding agent having affinity for Clec9A and wherein the antigen is administered in the absence of an adjuvant. Tolerance in this context typically involves depletion of immune cells which would otherwise be capable of responding to that antigen, or inducing a lasting reduction in responsiveness to an antigen in such immune cells.

It may be particularly desirable to raise a Treg response against an antigen to which the subject exhibits, or is at risk of developing, an undesirable immune response. For example, it may be a self-antigen against which an immune response occurs in an autoimmune disease. Examples of autoimmune diseases in which specific antigens have been identified as potentially pathogenically significant include multiple sclerosis (myelin basic protein), insulin-dependent diabetes mellitus (glutamic acid decarboxylase), insulin-resistant diabetes mellitus (insulin receptor), celiac disease (gliadin), bullous pemphigoid (collagen type XVII), autoimmune haemolytic anaemia (Rh protein), auto-immune thrombocytopenia (GpIIb/IIIa), myaesthenia gravis (acetylcholine receptor), Graves' disease (thyroid-stimulating hormone receptor), glomerulonephritis, such as Goodpasture's disease (alpha3(IV)NC1 collagen), and pernicious anaemia (intrinsic factor). Alternatively the target antigen may be an exogenous antigen which stimulates a response which also causes damage to host tissues. For example, acute rheumatic fever is caused by an antibody response to a Streptococcal antigen which cross-reacts with a cardiac muscle cell antigen. Thus these antigens, or particular fragments or epitopes thereof, may be suitable antigens for use in the present invention.

In some embodiments, the present agents, or methods using these agents, disrupt Clec9A signaling (e.g. via neutralization of Clec9A), e.g. by reducing or inhibiting Clec9A binding to its ligand. Some autoimmune diseases are characterized by unusually high levels of cell death and it is believed that immune responses against self antigens associated with these cells may contribute to the pathogenesis of these conditions. Clec9A antagonists may therefore be used to prevent Clec9A from binding to the ligand exposed in dead and dying cells (e.g. those undergoing immunogenic cell death) and may thus inhibit or prevent stimulation of immune responses against these antigens.

In various embodiments, the present agents, or methods using these agents, reduce or suppress autoreactive T cells. In some embodiments, the multi-specific Clec9a binding agent, optionally through an interferon signaling in the context of a chimera, causes this immunosuppression. In some embodiments, the multi-specific Clec9a binding agent stimulates PD-L1 or PD-L2 signaling and/or expression which may suppress autoreactive T cells. In some embodiments, the Clec9A binding agent, optionally through an interferon signaling in the context of a chimera, causes this immunosuppression. In some embodiments, the Clec9A binding agent stimulates PD-L1 or PD-L2 signaling and/or expression which may suppress autoreactive T cells.

In various embodiments, the present methods comprise modulating the ratio of regulatory T cells to effector T cells in favor of immunosuppression, for instance, to treat autoimmune diseases. For instance, the present methods, in some embodiments, reduce and/or suppress one or more of cytotoxic T cells; effector memory T cells; central memory T cells; $CD8^+$ stem cell memory effector cells; TH1 effector T-cells; TH2 effector T cells; TH9 effector T cells; TH17 effector T cells. For instance, the present methods, in some embodiments, increase and/or stimulate one or more of $CD4^+CD25^+FOXP3^+$ regulatory T cells, $CD4^+CD25^+$ regulatory T cells, $CD4^+CD25^-$ regulatory T cells, $CD4^+$ CD25high regulatory T cells, TIM-$3^+$PD-$1^+$ regulatory T cells, lymphocyte activation gene-3 (LAG-3)$^+$ regulatory T cells, CTLA-4/$CD152^+$ regulatory T cells, neuropilin-1 (Nrp-1)+ regulatory T cells, $CCR4^+CCR8^+$ regulatory T cells, CD62L (L-selectin)+ regulatory T cells, CD45RBlow regulatory T cells, CD127low regulatory T cells, LRRC32/$GARP^+$ regulatory T cells, $CD39^+$ regulatory T cells, $GITR^+$ regulatory T cells, $LAP^+$ regulatory T cells, $1B11^+$ regulatory T cells, $BTLA^+$ regulatory T cells, type 1 regulatory T cells (Tr1 cells), T helper type 3 (Th3) cells, regulatory cell of natural killer T cell phenotype (NKTregs), $CD8^+$ regulatory T cells, $CD8^+CD28^-$ regulatory T cells and/or regulatory T-cells secreting IL-10, IL-35, TGF-β, TNF-α, Galectin-1, IFN-γ and/or MCP1.

In some embodiments, the present methods favor immune inhibitory signals over immune stimulatory signals. In some embodiments, the present methods allow for reversing or suppressing immune activating or co-stimulatory signals. In some embodiments, the present methods allow for providing immune inhibitory signals. For instance, in some embodiments, the present agents and methods reduce the effects of an immune stimulatory signal, which, without limitation, is one or more of 4-1BB, OX-40, HVEM, GITR, CD27, CD28, CD30, CD40, ICOS ligand; OX-40 ligand, LIGHT (CD258), GITR ligand, CD70, B7-1, B7-2, CD30 ligand, CD40 ligand, ICOS, ICOS ligand, CD137 ligand and TL1A. Further, in some embodiments, the present agents and methods increase the effects of an immune inhibitory signal, which, without limitation, is one or more of CTLA-4, PD-L1, PD-L2, PD-1, BTLA, HVEM, TIM3, GAL9, LAG3, VISTA, KIR, 2B4, CD160 (also referred to as BY55), CGEN-15049, CHK 1 and CHK2 kinases, A2aR, CEACAM (e.g., CEACAM-1, CEACAM-3 and/or CEACAM-5), and various B-7 family ligands (including, but are not limited to, B7-1, B7-2, B7-DC, B7-H1, B7-H2, B7-H3, B7-H4, B7-H5, B7-H6 and B7-H7. Kits The present invention also provides kits for the administration of any Clec9A binding agent described herein (e.g. with or without additional therapeutic agents). The kit is an assemblage of materials or components, including at least one of the inventive pharmaceutical compositions described herein. Thus, in some embodiments, the kit contains at least one of the pharmaceutical compositions described herein.

The exact nature of the components configured in the kit depends on its intended purpose. In one embodiment, the kit is configured for the purpose of treating human subjects.

Instructions for use may be included in the kit. Instructions for use typically include a tangible expression describing the technique to be employed in using the components of the kit to effect a desired therapeutic outcome, such as to treat cancer. Optionally, the kit also contains other useful components, such as, diluents, buffers, pharmaceutically acceptable carriers, syringes, catheters, applicators, pipetting or measuring tools, bandaging materials or other useful paraphernalia as will be readily recognized by those of skill in the art.

The materials and components assembled in the kit can be provided to the practitioner stored in any convenience and suitable ways that preserve their operability and utility. For example, the components can be provided at room, refrigerated or frozen temperatures. The components are typically contained in suitable packaging materials. In various embodiments, the packaging material is constructed by well-known methods, preferably to provide a sterile, contaminant-free environment. The packaging material may have an external label which indicates the contents and/or purpose of the kit and/or its components.

Definitions

As used herein, "a," "an," or "the" can mean one or more than one.

Further, the term "about" when used in connection with a referenced numeric indication means the referenced numeric indication plus or minus up to 10% of that referenced numeric indication. For example, the language "about 50" covers the range of 45 to 55.

An "effective amount," when used in connection with medical uses is an amount that is effective for providing a measurable treatment, prevention, or reduction in the rate of pathogenesis of a disease of interest.

As used herein, something is "decreased" if a read-out of activity and/or effect is reduced by a significant amount, such as by at least about 10%, at least about 20%, at least about 30%, at least about 40%, at least about 50%, at least about 60%, at least about 70%, at least about 80%, at least about 90%, at least about 95%, at least about 97%, at least about 98%, or more, up to and including at least about 100%, in the presence of an agent or stimulus relative to the absence of such modulation. As will be understood by one of ordinary skill in the art, in some embodiments, activity is decreased and some downstream read-outs will decrease but others can increase.

Conversely, activity is "increased" if a read-out of activity and/or effect is increased by a significant amount, for example by at least about 10%, at least about 20%, at least about 30%, at least about 40%, at least about 50%, at least about 60%, at least about 70%, at least about 80%, at least about 90%, at least about 95%, at least about 97%, at least about 98%, or more, up to and including at least about 100% or more, at least about 2-fold, at least about 3-fold, at least about 4-fold, at least about 5-fold, at least about 6-fold, at least about 7-fold, at least about 8-fold, at least about 9-fold, at least about 10-fold, at least about 50-fold, at least about 100-fold, in the presence of an agent or stimulus, relative to the absence of such agent or stimulus.

As referred to herein, all compositional percentages are by weight of the total composition, unless otherwise specified. As used herein, the word "include," and its variants, is intended to be non-limiting, such that recitation of items in a list is not to the exclusion of other like items that may also be useful in the compositions and methods of this technology. Similarly, the terms "can" and "may" and their variants are intended to be non-limiting, such that recitation that an embodiment can or may comprise certain elements or features does not exclude other embodiments of the present technology that do not contain those elements or features.

Although the open-ended term "comprising," as a synonym of terms such as including, containing, or having, is used herein to describe and claim the invention, the present invention, or embodiments thereof, may alternatively be described using alternative terms such as "consisting of" or "consisting essentially of."

As used herein, the words "preferred" and "preferably" refer to embodiments of the technology that afford certain benefits, under certain circumstances. However, other embodiments may also be preferred, under the same or other circumstances. Furthermore, the recitation of one or more preferred embodiments does not imply that other embodiments are not useful, and is not intended to exclude other embodiments from the scope of the technology.

The amount of compositions described herein needed for achieving a therapeutic effect may be determined empirically in accordance with conventional procedures for the particular purpose. Generally, for administering therapeutic agents for therapeutic purposes, the therapeutic agents are given at a pharmacologically effective dose. A "pharmacologically effective amount," "pharmacologically effective dose," "therapeutically effective amount," or "effective amount" refers to an amount sufficient to produce the desired physiological effect or amount capable of achieving the desired result, particularly for treating the disorder or disease. An effective amount as used herein would include an amount sufficient to, for example, delay the development of a symptom of the disorder or disease, alter the course of a symptom of the disorder or disease (e.g., slow the progression of a symptom of the disease), reduce or eliminate one or more symptoms or manifestations of the disorder or disease, and reverse a symptom of a disorder or disease. Therapeutic benefit also includes halting or slowing the progression of the underlying disease or disorder, regardless of whether improvement is realized.

Effective amounts, toxicity, and therapeutic efficacy can be determined by standard pharmaceutical procedures in cell cultures or experimental animals, e.g., for determining the LD50 (the dose lethal to about 50% of the population) and the ED50 (the dose therapeutically effective in about 50% of the population). The dosage can vary depending upon the dosage form employed and the route of administration utilized. The dose ratio between toxic and therapeutic effects is the therapeutic index and can be expressed as the ratio LD50/ED50. In some embodiments, compositions and methods that exhibit large therapeutic indices are preferred. A therapeutically effective dose can be estimated initially from in vitro assays, including, for example, cell culture assays. Also, a dose can be formulated in animal models to achieve a circulating plasma concentration range that includes the IC50 as determined in cell culture, or in an appropriate animal model. Levels of the described compositions in plasma can be measured, for example, by high performance liquid chromatography. The effects of any particular dosage can be monitored by a suitable bioassay. The dosage can be determined by a physician and adjusted, as necessary, to suit observed effects of the treatment.

In certain embodiments, the effect will result in a quantifiable change of at least about 10%, at least about 20%, at least about 30%, at least about 50%, at least about 70%, or at least about 90%. In some embodiments, the effect will result in a quantifiable change of about 10%, about 20%, about 30%, about 50%, about 70%, or even about 90% or more. Therapeutic benefit also includes halting or slowing the progression of the underlying disease or disorder, regardless of whether improvement is realized.

As used herein, "methods of treatment" are equally applicable to use of a composition for treating the diseases or disorders described herein and/or compositions for use and/or uses in the manufacture of a medicaments for treating the diseases or disorders described herein.

EXAMPLES

Example 1. Construction and Evaluation of VHHs Specific for Human Clec9A

Isolation of Antigen-Specific VHHs

A VHH library was constructed from an immunized of a llama. Three consecutive rounds of panning of a VHH library were performed in solution using stably transfected CHO-K cells expressing human Clec9A. The enrichment for antigen-specific phages was assessed after each round of panning by comparing the number of phagemid particles eluted from transfected cells (output) with the number of phagemid particles used for panning (input). The phage output increased about 10-fold in the $2^{nd}$ round and about $10^3$-fold in the $3^{rd}$ round, as compared to the output from the $1^{st}$ round. The input phage was always about 1011 and the output from first round was about $10^8$ phage particles. 285 randomly selected colonies from the $1^{st}$, $2^{nd}$ and $3^{rd}$ panning rounds (95 from each round) were sequenced and then grouped based on CDR3 sequences. Using crude periplasmic extracts including VHHs, 95 unique sequences were analyzed by flow cytometry for specificity to human Clec9A using CHO-K1 cells stably transfected with human Clec9A. The parental non-transfected CHO-K1 cells served as negative control cell. An irrelevant VHH was used as negative nanobody control. Flow cytometry experiments revealed that 66 different VHHs, belonging to 25 different groups (see FIG. 3), were specific for human Clec9A. Table B below provides a description of 66 clones representing the 66 different anti-human Clec9A VHH genes. E. coli TG1 harboring recombinant phagemid pMECS containing anti-human Clec9A VHH sequences was generated and stored at −80° C. The vector pMECS codes for ampicillin resistance.

TABLE B

| E. coli strain + Vector | Nanobody (Nb) | NSF Reference No. (Glycerol stock) |
|---|---|---|
| TG1, pMECS | 1LEC 7 | 4826 |
| TG1, pMECS | 1LEC 9 | 4827 |
| TG1, pMECS | 1LEC 26 | 4828 |
| TG1, pMECS | 1LEC 27 | 4829 |
| TG1, pMECS | 1LEC 28 | 4830 |
| TG1, pMECS | 1LEC 30 | 4831 |
| TG1, pMECS | 1LEC 38 | 4832 |
| TG1, pMECS | 1LEC 42 | 4833 |
| TG1, pMECS | 1LEC 51 | 4834 |
| TG1, pMECS | 1LEC 61 | 4835 |
| TG1, pMECS | 1LEC 62 | 4836 |
| TG1, pMECS | 1LEC 63 | 4837 |
| TG1, pMECS | 1LEC 64 | 4838 |
| TG1, pMECS | 1LEC 70 | 4839 |
| TG1, pMECS | 1LEC 84 | 4840 |
| TG1, pMECS | 1LEC 88 | 4841 |
| TG1, pMECS | 1LEC 91 | 4842 |
| TG1, pMECS | 1LEC 92 | 4843 |
| TG1, pMECS | 1LEC 94 | 4844 |
| TG1, pMECS | 2LEC 6 | 4845 |
| TG1, pMECS | 2LEC 13 | 4846 |
| TG1, pMECS | 2LEC 16 | 4847 |
| TG1, pMECS | 2LEC 20 | 4848 |
| TG1, pMECS | 2LEC 23 | 4849 |
| TG1, pMECS | 2LEC 24 | 4850 |
| TG1, pMECS | 2LEC 26 | 4851 |
| TG1, pMECS | 2LEC 38 | 4852 |
| TG1, pMECS | 2LEC 48 | 4853 |
| TG1, pMECS | 2LEC 53 | 4854 |
| TG1, pMECS | 2LEC 54 | 4855 |
| TG1, pMECS | 2LEC 55 | 4856 |
| TG1, pMECS | 2LEC 59 | 4857 |
| TG1, pMECS | 2LEC 60 | 4858 |
| TG1, pMECS | 2LEC 61 | 4859 |
| TG1, pMECS | 2LEC 62 | 4860 |
| TG1, pMECS | 2LEC 63 | 4861 |
| TG1, pMECS | 2LEC67 | 4862 |
| TG1, pMECS | 2LEC 68 | 4863 |
| TG1, pMECS | 2LEC 76 | 4864 |
| TG1, pMECS | 2LEC 83 | 4865 |
| TG1, pMECS | 2LEC 88 | 4866 |
| TG1, pMECS | 2LEC 89 | 4867 |
| TG1, pMECS | 2LEC 90 | 4868 |
| TG1, pMECS | 2LEC 93 | 4869 |
| TG1, pMECS | 2LEC 95 | 4870 |
| TG1, pMECS | 3LEC 4 | 4871 |
| TG1, pMECS | 3LEC 6 | 4872 |
| TG1, pMECS | 3LEC 9 | 4873 |
| TG1, pMECS | 3LEC 11 | 4874 |
| TG1, pMECS | 3LEC 13 | 4875 |
| TG1, pMECS | 3LEC 15 | 4876 |
| TG1, pMECS | 3LEC 22 | 4877 |
| TG1, pMECS | 3LEC 23 | 4878 |
| TG1, pMECS | 3LEC 27 | 4879 |
| TG1, pMECS | 3LEC 30 | 4880 |
| TG1, pMECS | 3LEC 36 | 4881 |
| TG1, pMECS | 3LEC 55 | 4882 |
| TG1, pMECS | 3LEC 57 | 4883 |
| TG1, pMECS | 3LEC 61 | 4884 |
| TG1, pMECS | 3LEC 62 | 4885 |
| TG1, pMECS | 3LEC 66 | 4886 |
| TG1, pMECS | 3LEC 69 | 4887 |
| TG1, pMECS | 3LEC 76 | 4888 |
| TG1, pMECS | 3LEC 82 | 3889 |
| TG1, pMECS | 3LEC 89 | 4890 |
| TG1, pMECS | 3LEC 94 | 4891 |

Transformation of Non-Suppressor Strain (e.g. WK6) with Recombinant pMECS

The VHH gene cloned in pMECS vector contained PelB signal sequence at the N-terminus and HA tag and $His_6$ tag at the C-terminus (PelB leader-VHH-HA-$His_6$). The PelB leader sequence directed the VHH to the periplasmic space of the E. coli, and the HA and $His_6$ tags was used for the purification and detection of VHH (e.g. in ELISA, Western Blot, etc.).

In pMECS vector, the $His_6$ tag was followed by an amber stop codon (TAG) and this amber stop codon was followed by gene III of M13 phage. In suppressor E. coli strains (e.g. TG1), the amber stop codon was read as glutamine and therefore the VHH was expressed as fusion protein with protein III of the phage which allowed the display of the VHH on the phage coat for panning. In TG1 suppressor strains, the efficiency of suppression is not 100% and therefore the expression of VHHs in suppressor strains led to two different types of VHH molecules, fused to protein III and without protein III). In non-suppressor E. coli strains (e. g., WK6), the amber stop codon was read as stop codon and therefore the resulting VHH was not fused to protein III.

In order to express and purify VHHs cloned in pMECS vector, pMECS was prepared containing the gene of the VHH of interest, and the plasmid was transformed into a non-suppressor strain (e.g., WK6). The VHH of the resulting clone was sequenced using the MP057 primer (5'-TTATGCTTCCGGCTCGTATG-3') (SEQ ID NO: 1070) to verify the identity of the clone. Antigen binding capacity was retested by ELISA or any other appropriate assay. The non-suppressor strain (e.g., WK6) containing the recombinant pMECS vector with the VHH gene was used for the expression and purification of the VHH.

In pMECS vector, the $His_6$ tag was cleaved off upon storage of the VHH. Accordingly, the VHH gene was recloned from pMECS into pHEN6c vector, if the $His_6$ tag was to be used for detection, etc. Specifically, the VHH gene was amplified by PCR using recombinant pMECS harboring the VHH gene as template and primers A6E and PMCF. Primers A6E and PMCF were framework1 and framework4 primers, respectively. The primer sequences were as follows:

```
Primer A6E
                                   (SEQ ID NO: 1071)
(5' GAT GTG CAG CTG CAG GAG TCT GGR* GGA GG 3').

Primer PMCF
                                   (SEQ ID NO: 1072)
(5' CTA GTG CGG CCG CTG AGG AGA CGG TGA CCT GGG

T 3').

Universal reverse primer
                                   (SEQ ID NO: 1073)
(5' TCA CAC AGG AAA CAG CTA TGA C 3').

Universal forward primer
                                   (SEQ ID NO: 1074)
(5' CGC CAG GGT TTT CCC AGT CAC GAC 3').
```

*R stands for A or G. PstI, NotI and BstEII (Eco91I) recognition sequences are shown in bold, italic and underline, respectively.

The amplification protocol included about 30 cycles of PCR, each cycle included 30 seconds at 94° C., 30 seconds at 55° C. and 45 seconds at 72° C., followed by 10 minutes extension at 72° C. at the end of PCR. A fragment of about 400 bp was amplified.

The PCR product was purified (e.g. by Qiaquick PCR purification kit from Qiagen) and digested overnight with PstI. The purified PCR product was digested with BstEII overnight (or with Eco91I from Fermentas). The temperature used for digestion varied. For example, digestion with BstEII was done at 50° C. or 60° C. depending on the supplier of the enzyme.

For ligation, the PCR product was purified. The pHEN6c vector was digested with PstI for 3 hours, purified as described above, and then digested with BstEII for 2 to 3 hours. Alternatively, digestion was carried out using Eco91I from Fermentas. The digested vector was ran on 1% agarose gel, with the vector band excised out of the gel and purified (e.g. by Qiaquick gel extraction kit from Qiagen). The PCR fragment was subsequently ligated to the vector.

Electrocompetent WK6 cells were transformed with the ligation reaction, and transformants were selected using LB/agar/ampicillin (100 µg/ml)/glucose (1-2%) plates. Positive clones were screened by PCR using universal reverse and universal forward primers. A fragment of about 550 bp was amplified, if the insert was present. To verify the identity of the clones, at least 2 clones per each VHH were sequenced using universal reverse primers. Antigen binding capacity was retested by ELISA or any other appropriate assay.

Following the above protocol, the VHH gene cloned in pHEN6c vector was generated which contained PelB signal sequence at the N-terminus and $His_6$-tail at the C-terminus. The PelB leader sequence directed the VHH to the periplasmic space of the E. coli, and the His-tag was used for the purification and detection of VHH (e.g. in ELISA, Western Blot, etc.).

Expression and Purification of VHHs

Expression and purification of VHHs were carried out. Specifically, on day 1, 10-20 ml of LB+ampicillin (100 µg/ml)+glucose (1%) were innoculated with a freshly transformed WK6 colony. This pre-culture was incubated at 37° C. overnight with shaking at 200-250 rpm. On day 2, a TB medium was used for expressing the VHHs. The TB medium included, per liter: 2.3 g $KH_2PO_4$, 16.4 g $K_2HPO_4 \cdot 3H_2O$, 12 g Tryptone (Duchefa Biochemie), 24 g Yeast (Duchefa Biochemie), and 4 ml 100% glycerol (Duchefa Biochemie)

A baffled shaker flask of 1 liter was filled with 330 ml TB and autoclaved. $KH_2PO_4$ and $K_2HPO_4 \cdot 3H_2O$ were not autoclaved. Instead, $KH_2PO_4$ and $K_2HPO_4 \cdot 3H_2O$ were prepared, filter sterilized, and then added to the rest of the medium that was already autoclaved. About 1 ml of the pre-culture was added to 330 ml of TB supplemented with 100 µg/ml Ampicillin, 2 mM $MgCl_2$ and 0.1% glucose and subsequently grew at 37° C. with shaking (200-250 rpm) until an $OD_{600}$ of 0.6-0.9 was reached. IPTG (final concentration of 1 mM) was added to induce VHH expression. The culture was incubated at 28° C. with shaking overnight (about 16-18 hours). The $OD_{600}$ after overnight induction was usually between 25 and 30. At least 1 liter of culture (3 bottles) per clone was prepared with an average yield of between 1 and 15 mg/l.

Extraction of the VHHs from the periplasm of E. coli was carried out on day 3. The solutions used included: TES: 0.2 M Tris pH 8.0, 0.5 mM EDTA, 0.5 M sucrose, TES/4: TES diluted 4 times in water.

The overnight induced cultures were centrifuged for 8 minutes at 8000 rpm. The cell pellets from 1 liter culture were resuspended in 12 ml TES by pipetting up and down and shaken for 1 hour on ice. Per each 12 ml TES used, about 18 ml TES/4 were added and incubated on ice for an additional hour with shaking followed by centrifuge for 30 minutes at 8000 rpm at 4° C. The supernatant which contained proteins extracted from the periplasmic spaced was transferred to fresh falcon tubes.

The VHHs were subsequently purified by IMAC which utilized the following solution: HIS-select (SIGMA), PBS, and 50 mM NaAcetate pH 4.6.

His-select was equilibrated with PBS. Specifically, per periplasmic extract derived from 1 liter culture, 1 ml of Resin (about 2 ml His-select solution) was added to a 50 ml falcon tube. PBS was also added to final volume of 50 ml and mixed. Centrifugation was carried out at 2000 rpm for 2 minutes, and the supernatant was discarded. The resin was washed with PBS twice as described above. The periplasmic extract was added to the resin, incubated for 30 minutes to 1 hour at room temperature with gentle shaking. The samples were loaded on PD-10 columns with a filter at the bottom (GE healthcare, cat. No. 17-0435-01) and washed with 50 to 100 ml PBS (50-100 ml PBS per 1 ml resin used). Elution was carried out for 3 times, each time with 1 ml PBS/0.5 M imidazole per 1 ml resin used (for efficient elution, resuspend the beads and leave overnight at 4° C. with the bottom of the column closed). Dialysis was performed overnight at 4° C. against PBS (cutoff 3500 daltons) to remove imidazole. For efficient dialysis, the dialysis buffer (PBS) was changed 2-3 times. Alternatively, instead of elution with imidazole, the bound VHHs could be eluted with 10 ml 50 mM Na-acetate pH 4.6. If 50 mM Na-acetate pH 4.6 was used to elute VHHs, the eluted VHHs was immediately neutralized with 1M Tris pH 8.0, and no dialysis was required.

The amount of protein was estimated by $OD_{280}$ measurement of eluted sample. Extinction coefficient of each clone was determined by protParam tool under primary structure analysis at the Expasy proteomics server. Further purification of VHHs could be achieved by different methods. For example, the samples could be concentrated (Vivaspin 5000 MW cutoff, Vivascience) by centrifuging at 2000 rpm at 4° C. until an appropriate volume for loading on a Superdex 75 16/60 was obtained (max. 4 ml). The concentrated sample was loaded on a Superdex 75 16/60 column equilibrated with PBS. Peak fractions were pooled, and $OD_{280}$ measurements were performed for quantification. In general, VHHs eluted after 85-95 minutes when run at 1 ml/min. Aliquots of concentrated VHH samples were stored at −20° C. at a concentration of about 1 mg/ml.

Example 2. Functional Characterization of Human Clec9A Binding VHHs

The binding characteristics of various VHHs (as described in Example 1) were tested by flow cytometry. HEK293-T cells were transfected with a human Clec9A expression plasmid and stained with the His-tagged VHHs at 2 µg/ml, followed by staining with an anti-His Fitc conjugated antibody. Binding was measured by detecting cellular fluorescence via flow cytometry. Results as shown in FIG. 4 show that the VHHs bound to Clec9A.

Example 3. Dendritic Cell Signaling Induced by Anti-human Clec9A VHH Chimeras

The term "AcTaferon" is used herein to reference an interferon-based chimera. In the following example, unless noted, mutations to IFN are relative to human IFN-α2— SEQ ID NO:2.

A dendritic cell pSTAT signaling assay was undertaken. Chimeras studied were anti-human Clec9A VHH/human IFN R149A fusions. Two doses of the agents were studied: 100 ng/ml and 500 ng/ml.

The anti-human Clec9A VHHs used in this Example were 2LEC13, 2LEC20, 2LEC38, 3LEC6, and 3LEC30.

Briefly, human PBMCs were isolated from blood obtained from healthy donors. Approximately 120 ml of blood was collected from each donor using heparin coated tubes (12 tubes). The blood was kept at room temperature and processed immediately Briefly, blood was diluted 1:1 with DPBS and 25 ml was gently layered onto 15 ml of Lympholyte H. After centrifugation, the mononuclear cell rings were collected and cells were washed three times with DPBS (PBS Dulbecco's Phosphate Buffered Saline, Wisent, catalog #311-425-LL) and counted. Dendritic cells were enriched from the PBMC population using "DC-enrichment kit" containing a combination of lineage specific monoclonal antibodies in PBS and a suspension of magnetic particles (STEMCELL Technologies Catalogue number 19251), according to manufacturer's instructions.

Dendritic cells (DC) were stimulated for 15 minutes in the presence or absence of test items and controls (PBS) and the level of phosphorylated-STAT1 (pSTAT1, specifically pY701-STAT1) was determined in isolated DC cell populations (Lin−(CD14/CD16/CD20/CD56/CD3)/HLA-DR+) by flow cytometry. Post stimulation, cells were fixed (BD Cytofix fixation buffer, BD Bioscience, catalog #554655), then permeabilized with Perm buffer II (BD PhosFlow Perm Buffer, BD Bioscience, catalog #558052). Cells were then stained for phosphoSTAT1 and for DC surface markers (Lin−/HLA−DR+) (see Table C below). Both intra-cellular and surface staining were performed at the same time. Flow cytometry and data acquisition was performed after cell washing with DPBS.

framework hallmark residues at positions 37, 44, 45, 47 and 84 (US2008/0107601; Kabat numbering schedule) were not humanized, while the N-terminal Q in both sequences was mutated to D to avoid pyroglutamate formation. Four variant sequences of R1CHCL50 and 3LEC89 were generated and tested.

R1CHCL50 (wild type):
(SEQ ID NO: 327)
QVQLVESGGGLVHPGGSLRLSCAASGSFSSINVMGWYRQAPGKERELVAR

ITNLGLPNYADSVTGRFTISRDNAKNTVYLQMNSLKPEDTAVYYCYLVAL

KAEYWGQGTQVTVSS;

R1CHCL50_opt1 (E1D-A74S-K83R-Q108L):
(SEQ ID NO: 328)
DVQLVESGGGLVHPGGSLRLSCAASGSFSSINVMGWYRQAPGKERELVAR

ITNLGLPNYADSVTGRFTISRDNSKNTVYLQMNSLRPEDTAVYYCYLVAL

KAEYWGQGTLVTVSS;

R1CHCL50_opt2 (E1D-A74S-K83R-Q108L-H13Q):
(SEQ ID NO: 329)
DVQLVESGGGLVQPGGSLRLSCAASGSFSSINVMGWYRQAPGKERELVAR

ITNLGLPNYADSVTGRFTISRDNSKNTVYLQMNSLRPEDTAVYYCYLVAL

KAEYWGQGTLVTVSS;

TABLE C

List of antibodies for flow cytometry staining

| Marker/Product Name | Fluorochrome | Clone | Purpose | Supplier-Catalog Number |
|---|---|---|---|---|
| pSTAT1 | AlexaFlour647 | 4a | phospho-STAT1 | BD-562070 |
| Anti-human CD3 | PE | UCHT1 | T cells marker Lineage depletion | BD-561809 |
| Anti-human CD14 | PE | M5E2 | Monocytes markers Lineage depletion | BD-555398 |
| anti-human CD16 | PE | B73.1 | NK, Neutrophils, Monocytes marker Lineage depletion | BD-561313 |
| anti-human CD19 | PE | H1B19 | B cells marker Lineage depletion | BD-555413 |
| anti-human CD56 | PE | B159 | NK cells marker Lineage depletion | BD-555516 |
| Anti-human HLA-DR | FITC | TU36 | MHC II marker DC discrimination | BD-555560 |
| Anti-human CD11c | BV421 | B-Ly6 | DC discrimination | BD-562561 |
| LIVE/DEAD Fixable Aqua Dead Cell Stain | Aqua | N/Ap | Viability dye | ThermoFisher-L34957 |
| Normal mouse IgG | N/Ap | N/Ap | Fc receptor blocker Blocking agent | ThermoFisher-10400C |

Figure 5:
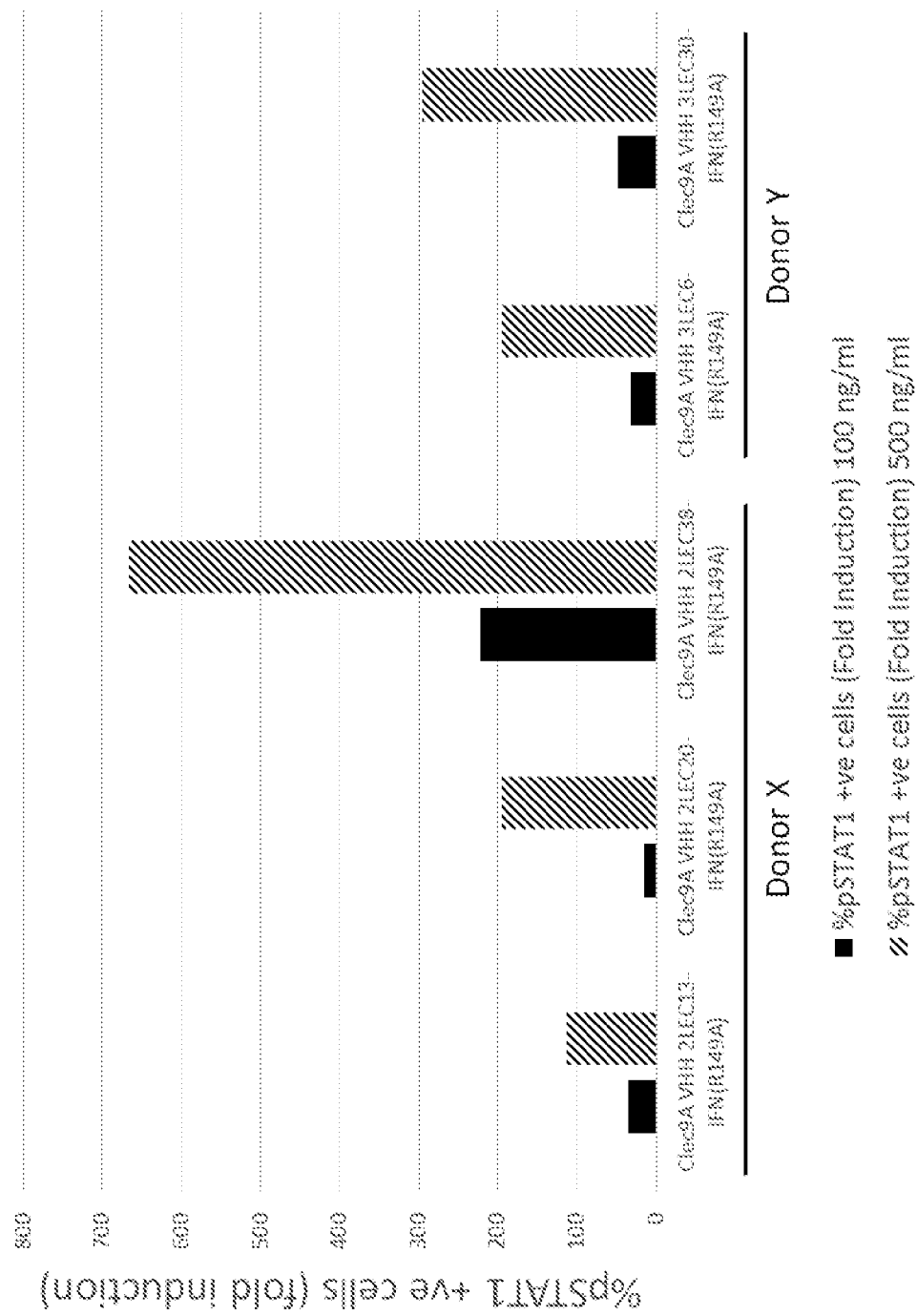
FIG. 5 shows a human dendritic cell pSTAT1 signaling assay. Chimeras studied were various anti-human Clec9A VHH/human IFNα R149A. Two doses of the agents were studied: 100 ng/ml and 500 ng/ml. PBS was the control and the data are expressed as a fold change of the percentage of pSTAT1$^+$ dendritic cells (data is an average of a triplicate data set).
Figure 6:
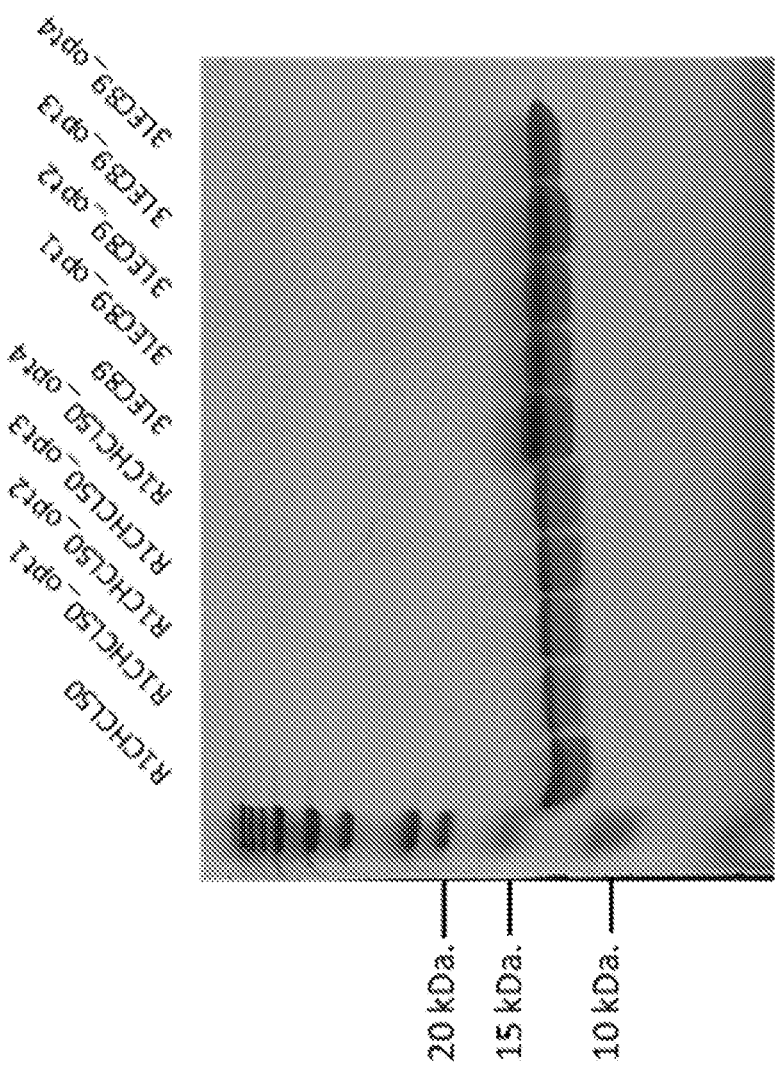
FIG. 6 shows the purification and production of Clec9A targeting moieties R1CHCL50, 3LEC89, and variants thereof.

FIG. 5 shows the data, expressed as a fold change of the percentage of pSTAT+ dendritic cells.

This study clearly shows that a human CLEC9A antigen-targeting construct comprising an IFN signaling agent whose activity is recoverable upon cell targeting (IFN R149A) promotes IFN signaling in human dendritic cells (as determined by pSTAT1 induction). Thus, targeting IFN to human dendritic cells using a targeting moiety directed at human CLEC9A antigen results in triggering of a pronounced IFN signal transduction.

Example 4. Construction and Evaluation of VHHs Specific for Human Clec9A

Variants of human Clec9A VHH R1CHCL50 and 3LEC89 were produced and analyzed. The typical VHH -continued R1CHCL50_opt3 (E1D-A74S-K83R-Q108L-T64K):
(SEQ ID NO: 330)
DVQLVESGGGLVHPGGSLRLSCAASGSFSSINVMGWYRQAPGKERELVAR

ITNLGLPNYADSVKGRFTISRDNSKNTVYLQMNSLRPEDTAVYYCYLVAL

KAEYWGQGTLVTVSS;

R1CHCL50_opt4 (E1D-A74S-K83R-Q108L-H13Q-T64K):
(SEQ ID NO: 331)
DVQLVESGGGLVQPGGSLRLSCAASGSFSSINVMGWYRQAPGKERELVAR

ITNLGLPNYADSVKGRFTISRDNSKNTVYLQMNSLRPEDTAVYYCYLVAL

KAEYWGQGTLVTVSS;

-continued

3LEC_89 (wild type):
(SEQ ID NO: 332)
QVQLQESGGGLVQPGGSLRLSCAASGRIFSVNAMGWYRQAPGKQRELVAA

ITNQGAPTYADSVKGRFTISRDNAGNTVYLQMNSLRPEDTAVYYCKAFTR

GDDYWGQGTQVTVSS;

3LEC_89_opt1 (E1D-Q5V-Q108L):
(SEQ ID NO: 333)
DVQLVESGGGLVQPGGSLRLSCAASGRIFSVNAMGWYRQAPGKQRELVAA

ITNQGAPTYADSVKGRFTISRDNAGNTVYLQMNSLRPEDTAVYYCKAFTR

GDDYWGQGTLVTVSS;

3LEC_89_opt2 (E1D-Q5V-Q108L-A74S):
(SEQ ID NO: 334)
DVQLVESGGGLVQPGGSLRLSCAASGRIFSVNAMGWYRQAPGKQRELVAA

ITNQGAPTYADSVKGRFTISRDNSGNTVYLQMNSLRPEDTAVYYCKAFTR

GDDYWGQGTLVTVSS;

3LEC_89_opt3 (E1D-Q5V-Q108L-G75K):
(SEQ ID NO: 335)
DVQLVESGGGLVQPGGSLRLSCAASGRIFSVNAMGWYRQAPGKQRELVAA

ITNQGAPTYADSVKGRFTISRDNAKNTVYLQMNSLRPEDTAVYYCKAFTR

GDDYWGQGTLVTVSS;
and

3LEC_89_opt4 (E1D-Q5V-Q108L-A74S-G75K):
(SEQ ID NO: 336)
DVQLVESGGGLVQPGGSLRLSCAASGRIFSVNAMGWYRQAPGKQRELVAA

ITNQGAPTYADSVKGRFTISRDNSKNTVYLQMNSLRPEDTAVYYCKAFTR

GDDYWGQGTLVTVSS.

Production and Purification

Wild type and variants (opt1 through opt4) were synthesized by GeneArt (ThermoFisher) and cloned in the pHEN6C vector for bacterial periplasmic expression with a C-terminal his6 tag. Resulting constructs were transformed in WK6 cells. VHH expression was induced overnight with 1 mM IPTG, cells pelleted, and periplasmic extracts prepared using TES (0.2 M Tris pH 8.0, 0.5 mM EDTA, 0.5 M sucrose) and TES/4 buffers. Proteins were purified from extracts using the TALON Metal affinity resin according to the manufacturer's guidelines and imidazole was removed from the samples using PD10 columns (GE Healthcare). Average yields ranged from 0.8 to 5 mg per liter culture (see FIG. 6 and Table D).

TABLE D

| | Yield (mg per liter) |
|---|---|
| R1CHCL50 | 2.69 |
| R1CHCL50_opt1 (E1D-A74S-K83R-Q108L) | 0.86 |
| R1CHCL50_opt2 (E1D-A74S-K83R-Q108L-H13Q) | 1.15 |
| R1CHCL50_opt3 (E1D-A74S-K83R-Q108L-T64K) | 1.30 |
| R1CHCL50_opt4 (E1D-A74S-K83R-Q108L-H13Q-T64K) | 1.53 |
| 3LEC89 | 4.31 |
| 3LEC_89_opt1 (E1D-Q5V-Q108L) | 1.65 |
| 3LEC_89_opt2 (E1D-Q5V-Q108L-A74S) | 2.45 |
| 3LEC_89_opt3 (E1D-Q5V-Q108L-G75K) | 2.33 |
| 3LEC_89_opt4 (E1D-Q5V-Q108L-A74S-G75K) | 1.39 |

Thermostability and Affinity

Thermostabilities of the resulting VHH's were determined using SYPRO orange (Sigma-Aldrich) on a Light-Cycler 480 system (Roche) according to the manufacturers guidelines. Melting temperatures, calculated with the Protein Melting Analysis software (Roche), ranged from 75 to 83° C. and are summarized in Table E.

TABLE E

| | Melting temperature (° C.) |
|---|---|
| R1CHCL50 | 77.51 |
| R1CHCL50_opt1 (E1D-A74S-K83R-Q108L) | 78.51 |
| R1CHCL50_opt2 (E1D-A74S-K83R-Q108L-H13Q) | 79.38 |
| R1CHCL50_opt3 (E1D-A74S-K83R-Q108L-T64K) | 82.60 |
| R1CHCL50_opt4 (E1D-A74S-K83R-Q108L-H13Q-T64K) | 82.07 |
| 3LEC89 | 75.08 |
| 3LEC_89_opt1 (E1D-Q5V-Q108L) | 73.14 |
| 3LEC_89_opt2 (E1D-Q5V-Q108L-A74S) | 77.46 |
| 3LEC_89_opt3 (E1D-Q5V-Q108L-G75K) | 77.35 |
| 3LEC_89_opt4 (E1D-Q5V-Q108L-A74S-G75K) | 77.47 |

Affinity

Affinities of the AFN's for Clec9A were determined using the bio-layer interferometry technology on an Octet system (ForteBio). For this purpose, biotinylated human CLEC9A was captured on a streptavidin sensor and affinity determined for 3 concentrations of VHH (50, 100 and 200 nM). Results from a global analysis of the 3 concentrations tested are summarized in Table F.

TABLE F

Affinities of VHH's for human Clec9A

| VHH | KD (M) | Kon (1/Ms) | Kdis (1/s) |
|---|---|---|---|
| R1CHCL50 | 1.719E−09 | 4.10E+05 | 7.05E−04 |
| R1CHCL50_opt1 (E1D-A74S-K83R-Q108L) | 1.291E−09 | 4.92E+05 | 6.35E−04 |
| R1CHCL50_opt2 (E1D-A74S-K83R-Q108L-H13Q) | 1.147E−09 | 6.30E+05 | 7.23E−04 |
| R1CHCL50_opt3 (E1D-A74S-K83R-Q108L-T64K) | 1.786E−09 | 5.59E+05 | 9.98E−04 |
| R1CHCL50_opt4 (E1D-A74S-K83R-Q108L-H13Q-T64K) | 2.697E−09 | 4.38E+05 | 1.18E−03 |
| 3LEC89 | 1.74E−09 | 4.16E+05 | 7.25E−04 |
| 3LEC_89_opt1 (E1D-Q5V-Q108L) | 2.204E−09 | 3.91E+05 | 8.61E−04 |
| 3LEC_89_opt2 (E1D-Q5V-Q108L-A74S) | 2.413E−09 | 3.38E+05 | 8.17E−04 |
| 3LEC_89_opt3 (E1D-Q5V-Q108L-G75K) | 2.556E−09 | 4.38E+05 | 1.12E−03 |
| 3LEC_89_opt4 (E1D-Q5V-Q108L-A74S-G75K) | 2.352E−09 | 4.17E+05 | 9.82E−04 |

Example 5. Construction and Evaluation of Chimeric Proteins Targeting Human Clec9A Chimeric proteins comprising a human Clec9A targeting moiety and a mutated human IFNα2 signalling moiety (R149A) were constructed and analyzed.

Construction, Production and Purification of Chimeric Proteins

Human Clec9A VHH's R1CHCL50 and 3LEC89 were genetically fused to human IFNα2 R149A via a (GGS)

₃linker. Constructs were synthesized by GeneArt (ThermoFisher) and cloned in the pHEN6C vector for bacterial periplasmic expression. After transformation in WK6 cells, AFN expression was induced overnight with 1 mM IPTG, cells were pelleted, and periplasmic extracts prepared using TES (0.2 M Tris pH 8.0, 0.5 mM EDTA, 0.5 M sucrose) and TES/4 buffers. Proteins were purified from extracts using the TALON Metal affinity resin according to the manufacturer's guidelines and imidazole was removed from the samples using PD10 columns (GE Healthcare).

Affinity

Affinities of the chimeric proteins for Clec9A were determined using the bio-layer interferometry technology on an Octet system (ForteBio). For this purpose, biotinylated human CLEC9A was captured on a streptavidin sensor and affinity was determined for 3 concentrations (12.5, 25 and 50 nM) of each chimeric protein. Results from a global analysis of the 3 concentrations tested are summarized in Table G.

TABLE G

Affinities of Chimeric Proteins Targeting Human Clec9A

| Chimeric Protein | KD (M) | Kon (1/Ms) | Kdis (1/s) |
|---|---|---|---|
| R1CHCL50-(GGS)₃-hIFNa2_R149A | 1.95E−09 | 1.34E+05 | 2.60E−04 |
| 3LEC89-(GGS)₃-hIFNa2_R149A | 1.76E−09 | 2.45E+05 | 4.32E−04 |

Biological Activity

Figure 7A:
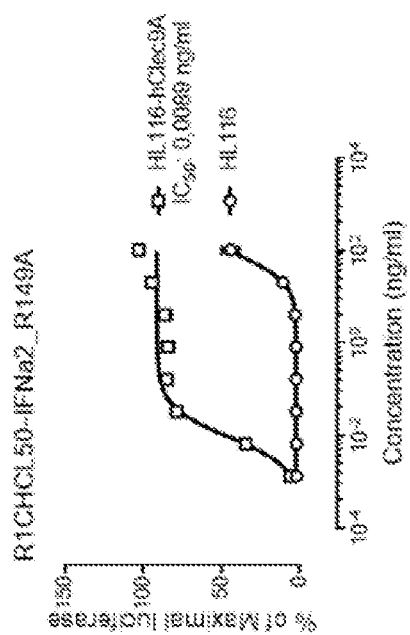
FIGS. 7A-B are graphs showing the biological activity of chimeric proteins having Clec9A targeting moieties (R1CHCL50 and 3LEC89) and mutated human IFNα2 (R149A) signaling moieties against HL116 and HL116-hClec9A cells.
Figure 7B:
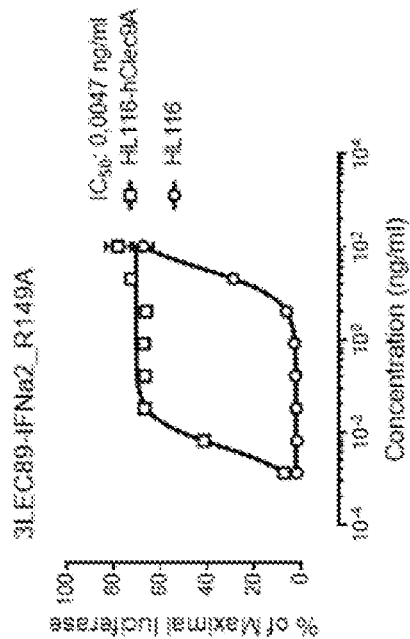

The HL116 clone is derived from the human HT1080 cell line (ATCC CCL-121). It contains the firefly luciferase gene controlled by the IFN-inducible 6-16 promoter. Parental HL116 cells were transfected with an expression-vector encoding the human Clec9A sequence. Stable transfected clones were selected in G418-containing medium. Parental HL116 and HL116-hClec9A cells were seeded overnight at 20,000 cells per 96-well, and stimulated with a serial dilution of chimeric protein for 6 hours. Luciferase activity was measured in cell lysates. Representative graphs are shown in FIGS. 7A-B. As shown in FIGS. 7A-B, the chimeric proteins had nearly no activity on Clec9A negative H116 cells. But the activity of the chimeric proteins was recovered in H116 cells expressing Clec9A.

Example 6. In Vivo Efficacy of Human CLEC9A AcTaferons

The CLEC9A VHHs 2LEC 16, 3LEC 22, 1LEC 28, 3LEC 30, and 3LEC 89, which belong to 4 different sequence groups, were selected to be evaluated for their in vivo antitumor efficacy in human CLEC9A VHH targeted AcTaferon (AFN) compositions (e.g., 2LEC16-hIFNα2_R149A, 3LEC22-hIFNa2_R149A, 1LEC28-hIFNa2_R149A, 3LEC30-hIFNa2_R149A, or 3LEC89-hIFNa2_R149A).

Human RL follicular lymphoma cell line (RL) tumor model in mice with humanized immune system: Mice with a humanized immune system were generated according to the following protocol. Mononuclear cells were collected following density gradient centrifugation using Lymphoprep from HLA-A2+ human cord blood samples. Human CD34+ hematopoietic stem cells (HSC) were isolated by MACS technology and examined for CD34+ purity and CD3+ contamination using FACS. HSC's with a CD34 purity of >80% were intrahepatically injected in 2-3 day old NSG mice that underwent myeloablative irradiation treatment at 100 cGy. At 8-12 weeks post HSC injection, human cell engraftment was analyzed with panleukocyte human and mouse CD45 markers using FACS and mice with >5% human CD45 cells, of total viable blood lymphocytes, were selected for tumor implantation. Twelve weeks post HSC injection, mice were subcutaneously injected with $2\times10^6$ RL tumor cells. Five days later, mice were treated with Flt3L injected peritoneally on a daily basis until day 18. Treatment with PBS (control) or 30 μg human CLEC9A targeted AFNs was initiated by daily perilesional administration as of day 11 (when tumors had reached sizes of about 10 mm²) post tumor injection.

Figure 8:
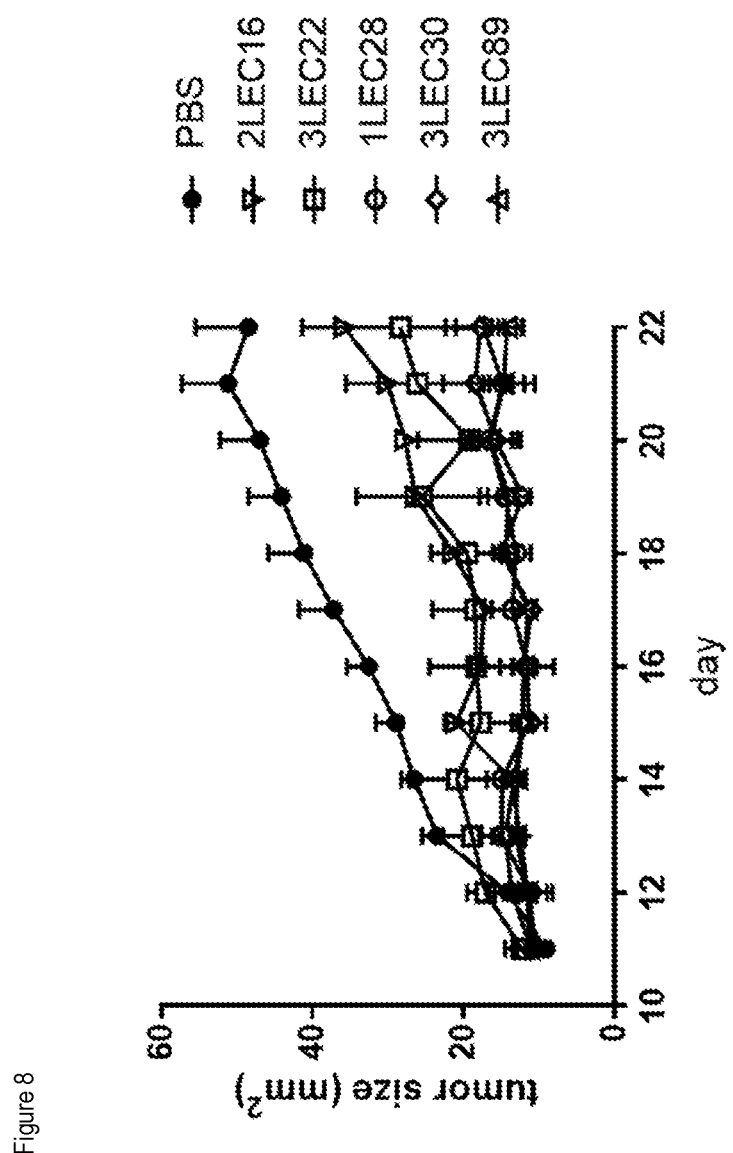
FIG. 8 is a graph showing in vivo anti-tumoral activity of CLEC9A based-AFN (e.g., 2LEC16-hIFNa2_R149A, 3LEC22-hIFNa2_R149A, 1LEC28-hIFNa2_R149A, 3LEC30-hIFNa2_R149A, and 3LEC89-hIFNa2_R149A) in mice with a humanized immune system having an RL tumor.

As shown in FIG. 8, the CLEC9A VHH targeted AFNs had in vivo anti-tumor activity.

EQUIVALENTS

While the invention has been described in connection with specific embodiments thereof, it will be understood that it is capable of further modifications and this application is intended to cover any variations, uses, or adaptations of the invention following, in general, the principles of the invention and including such departures from the present disclosure as come within known or customary practice within the art to which the invention pertains and as may be applied to the essential features hereinbefore set forth and as follows in the scope of the appended claims.

Those skilled in the art will recognize, or be able to ascertain, using no more than routine experimentation, numerous equivalents to the specific embodiments described specifically herein. Such equivalents are intended to be encompassed in the scope of the following claims.

INCORPORATION BY REFERENCE

All patents and publications referenced herein are hereby incorporated by reference in their entireties.

The publications discussed herein are provided solely for their disclosure prior to the filing date of the present application. Nothing herein is to be construed as an admission that the present invention is not entitled to antedate such publication by virtue of prior invention.

As used herein, all headings are simply for organization and are not intended to limit the disclosure in any manner. The content of any individual section may be equally applicable to all sections.

REFERENCES

The following are hereby incorporated by reference in their entireties:

Hart D N (1997) Dendritic cells: unique leukocyte populations which control the primary immune response. *Blood* 90: 3245-3287

Banchereau J and Steinman R M (1998) Dendritic cells and the control of immunity. *Nature* 392: 245-252

Bell D, Young J W and Banchereau J (1999) Dendritic cells. *Advances in Immunology* 72: 255-324

Shortman K and Liu Y J (2002) Mouse and human dendritic cell subtypes. *Nature Reviews Immunology* 2: 151-161

Poulin L F, Salio M, Griessinger E, Anjos-Afonso F, Craciun L, Chen J L, Keller A M, Joffre O, Zelenay S, Nye E, Le Moine A, Faure F, Donckier V, Sancho D, Cerundolo V, Bonnet D and Reis e Sousa C (2010) Characterization of human DNGR-1+BDCA3+ leukocytes as putative equivalents of mouse CD8alpha+ dendritic cells. *The Journal of Experimental Medicine* 207: 1261-1271

Shortman K and Heath W R (2010) The CD8+ dendritic cell subset. *Immunological Reviews* 234: 18-31

Den Haan J M, Lehar S M and Bevan M J (2000) CD8(+) but not CD8(−) dendritic cells cross-prime cytotoxic T cells in vivo. *Journal of Experimental Medicine* 192: 1685-1696

Heath W R, Belz G T, Behrens G M, Smith C M, Forehan S P, Parish I A, Davey G M, Wilson N S, Carbone F R and Villadangos J A (2004) Cross-presentation, dendritic cell subsets, and the generation of immunity to cellular antigens. *Immunological Reviews* 199: 9-26

Dallal R M and Lotze M T (2000) The dendritic cell and human cancer vaccines. *Current Opinion in Immunology* 12: 583-588

Steinman R M and Dhodapkar M (2001) Active immunization against cancer with dendritic cells: the near future. *International Journal of Cancer* 94: 459-473

Hsu F J, Benike C, Fagnoni F, Liles T M, Czerwinski D, Taidi B, Engleman E G and Levy R (1996) Vaccination of patients with B-cell lymphoma using autologous antigen-pulsed dendritic cells. *Nature Medicine* 2: 52-58

Radford K J and Caminschi I (2013) New generation of dendritic cell vaccines. *Human Vaccines & Immunotherapeutics* 9: 259-264

Bozzacco L, Trumpfheller C, Siegal F P, Mehandru S, Markowitz M, Carrington M, Nussenzweig M C, Piperno A G and Steinman R M (2007) DEC-205 receptor on dendritic cells mediates presentation of HIV gag protein to CD8+ T cells in a spectrum of human MHC I haplotypes. *Proceedings of the National Academy of Sciences of the United States of America* 104: 1289-1294

Birkholz K, Schwenkert M, Kellner C, Gross S, Fey G, Schuler-Thurner B, Schuler G, Schaft N and Dorrie J (2010) Targeting of DEC-205 on human dendritic cells results in efficient MHC class II-restricted antigen presentation. *Blood* 116: 2277-2285

Flynn B J, Kastenmuller K, Wille-Reece U, Tomaras G D, Alam M, Lindsay R W, Salazar A M, Perdiguero B, Gomez C E, Wagner R, Esteban M, Park C G, Trumpfheller C, Keler T, Pantaleo G, Steinman R M and Seder R (2011) Immunization with HIV Gag targeted to dendritic cells followed by recombinant New York vaccinia virus induces robust T-cell immunity in nonhuman primates. *Proceedings of the National Academy of Sciences of the United States of America* 108: 7131-7136

Idoyaga J, Lubkin A, Fiorese C, Lahoud M H, Caminschi I, Huang Y, Rodriguez A, Clausen B E, Park C G, Trumpfheller C and Steinman R M (2011) Comparable T helper 1 (Th1) and CD8 T-cell immunity by targeting HIV gag p24 to CD8 dendritic cells within antibodies to Langerin, DEC205, and Clec9A. *Proceedings of the National Academy of Sciences of the United States of America* 108: 2384-2389

Sancho D, Joffre O P, Keller A M, Rogers N C, Martinez D, Hernanz-Falcon P, Rosewell I and Reis e Sousa C (2009) Identification of a dendritic cell receptor that couples sensing of necrosis to immunity. *Nature* 458: 899-903

Caminschi I, Proietto A I, Ahmet F, Kitsoulis S, Shin Teh J, Lo J C, Rizzitelli A, Wu L, Vremec D, van Dommelen S L, Campbell I K, Maraskovsky E, Braley H, Davey G M, Mottram P, van de Velde N, Jensen K, Lew A M, Wright M D, Heath W R, Shortman K and Lahoud M H (2008) The dendritic cell subtype-restricted C-type lectin Clec9A is a target for vaccine enhancement. *Blood* 112: 3264-3273

Sancho D, Mourao-Sa D, Joffre O P, Schulz O, Rogers N C, Pennington D J, Carlyle J R and Reis e Sousa C (2008) Tumor therapy in mice via antigen targeting to a novel, D C-restricted C-type lectin. *Journal of Clinical Investigation* 118: 2098-2110

Lahoud M H, Ahmet F, Kitsoulis S, Wan S S, Vremec D, Lee C N, Phipson B, Shi W, Smyth G K, Lew A M, Kato Y, Mueller S N, Davey G M, Heath W R, Shortman K and Caminschi I (2011) Targeting antigen to mouse dendritic cells via Clec9A induces potent CD4 T cell responses biased toward a follicular helper phenotype. *Journal of Immunology* 187: 842-850

Schreibelt G, Klinkenberg L J, Cruz L J, Tacken P J, Tel J, Kreutz M, Adema G J, Brown G D, Figdor C G and de Vries I J (2012) The C-type lectin receptor CLEC9A mediates antigen uptake and (cross-)presentation by human blood BDCA3+ myeloid dendritic cells. *Blood* 119: 2284-2292

Wesolowski J, Alzogaray V, Reyelt J, Unger M, Juarez K, Urrutia M, Cauerhff A, Danquah W, Rissiek B, Scheuplein F, Schwarz N, Adriouch S, Boyer O, Seman M, Licea A, Serreze D V, Goldbaum F A, Haag F and Koch-Nolte F (2009) Single domain antibodies: promising experimental and therapeutic tools in infection and immunity. *Medical Microbiology and Immunology* 198: 157-174

Harmsen M M and De Haard H J (2007) Properties, production, and applications of camelid single-domain antibody fragments. *Applied Microbiology and Biotechnology* 77: 13-22

Dolk E, van Vliet C, Perez J M, Vriend G, Darbon H, Ferrat G, Cambillau C, Frenken L G and Verrips T (2005) Induced refolding of a temperature denatured llama heavy-chain antibody fragment by its antigen. *Proteins* 59: 555-564

Muyldermans S (2013) Nanobodies: natural single-domain antibodies. *Annual Review of Biochemistry* 82: 775-797

Lesterhuis W J, Aarntzen E H, De Vries I J, Schuurhuis D H, Figdor C G, Adema G J and Punt C J (2008) Dendritic cell vaccines in melanoma: from promise to proof? *Critical Reviews in Oncology/Hematology* 66: 118-134

Vulink A, Radford K J, Melief C and Hart D N (2008) Dendritic cells in cancer immunotherapy. *Advances in Cancer Research* 99: 363-407

Luft T, Pang K C, Thomas E, Hertzog P, Hart D N, Trapani J and Cebon J (1998) Type I IFNs enhance the terminal differentiation of dendritic cells. *Journal of Immunology* 161: 1947-1953

Paquette R L, Hsu N C, Kiertscher S M, Park A N, Tran L, Roth M D and Glaspy J A (1998) Interferon-alpha and granulocyte-macrophage colony-stimulating factor differentiate peripheral blood monocytes into potent antigen-presenting cells. *Journal of Leukocyte Biology* 64: 358-367

Radvanyi L G, Banerjee A, Weir M and Messner H (1999) Low levels of interferon-alpha induce CD86 (B7.2) expression and accelerates dendritic cell maturation from human peripheral blood mononuclear cells. *Scandinavian Journal of Immunology* 50: 499-509

SEQUENCE LISTING (1206 sequences)

SEQ ID NO: 1 - protein, 241 aa, Artificial Sequence
  Synthetic polymer
MHEEEIYTSLQWDSPAPDTYQKCLSSNKCSGACCLVMVISCVFCMGLLTASIFLGVKLLQVSTIAMQQQEKLIQQERALLNFTEWKRSCALQMKYCQAFMQNSLSSAHNSSPCPNNWIQNRESCYYVSEIWSIWHTSQENCLKEGSTLLQIESKEEMDFITGSLRKIKGSYDYWVGLSQDGHSGRWLWQDGSSPSPGLLPAERSQSANQVCGYVKSNSLLSSNCSTWKYFICEKYALRSSV

SEQ ID NO: 2 - protein, 10 aa, Artificial Sequence
  Synthetic polymer
GRISSINSMG

SEQ ID NO: 3 - protein, 10 aa, Artificial Sequence
  Synthetic polymer
GSITSINAMG

SEQ ID NO: 4 - protein, 10 aa, Artificial Sequence
  Synthetic polymer
GRFFRVNAMG

SEQ ID NO: 5 - protein, 10 aa, Artificial Sequence
  Synthetic polymer
GSSDSINAMG

SEQ ID NO: 6 - protein, 10 aa, Artificial Sequence
  Synthetic polymer
GSVFSINAWG

SEQ ID NO: 7 - protein, 10 aa, Artificial Sequence
  Synthetic polymer
GSILSINSMG

SEQ ID NO: 8 - protein, 10 aa, Artificial Sequence
  Synthetic polymer
VSISSINSMG

SEQ ID NO: 9 - protein, 10 aa, Artificial Sequence
  Synthetic polymer
GRVFSINAMG

SEQ ID NO: 10 - protein, 10 aa, Artificial Sequence
  Synthetic polymer
VNIDTLNSMA

SEQ ID NO: 11 - protein, 10 aa, Artificial Sequence
  Synthetic polymer
GGISSINSMG

SEQ ID NO: 12 - protein, 10 aa, Artificial Sequence
  Synthetic polymer
GSMHSVNSMA

SEQ ID NO: 13 - protein, 10 aa, Artificial Sequence
  Synthetic polymer
GDISSINAMG

SEQ ID NO: 14 - protein, 10 aa, Artificial Sequence
  Synthetic polymer
GSIFSIDAMG

SEQ ID NO: 15 - protein, 10 aa, Artificial Sequence
  Synthetic polymer
GSIFSINAMG

SEQ ID NO: 16 - protein, 10 aa, Artificial Sequence
  Synthetic polymer
GSIFSIAAMG

SEQ ID NO: 17 - protein, 10 aa, Artificial Sequence
  Synthetic polymer
GNIASITAMG

SEQ ID NO: 18 - protein, 10 aa, Artificial Sequence
  Synthetic polymer
GFTFDDYAIG

SEQ ID NO: 19 - protein, 10 aa, Artificial Sequence
  Synthetic polymer
GSISSINAMG

SEQ ID NO: 20 - protein, 10 aa, Artificial Sequence
  Synthetic polymer
VSIFRSYFMG

SEQ ID NO: 21 - protein, 10 aa, Artificial Sequence
  Synthetic polymer
GSIVSINAIG

SEQ ID NO: 22 - protein, 10 aa, Artificial Sequence
  Synthetic polymer
RSFSSFNAMG

SEQ ID NO: 23 - protein, 10 aa, Artificial Sequence
  Synthetic polymer
GSFSSINAMG

SEQ ID NO: 24 - protein, 10 aa, Artificial Sequence
  Synthetic polymer
GTSFSINGMA

SEQ ID NO: 25 - protein, 10 aa, Artificial Sequence
  Synthetic polymer
GRTFSTYAMG

SEQ ID NO: 26 - protein, 10 aa, Artificial Sequence
  Synthetic polymer
GRIFDINAMG

SEQ ID NO: 27 - protein, 10 aa, Artificial Sequence
  Synthetic polymer
GTLFSINGMA

SEQ ID NO: 28 - protein, 10 aa, Artificial Sequence
  Synthetic polymer
GSIDSINAMG

SEQ ID NO: 29 - protein, 10 aa, Artificial Sequence
  Synthetic polymer
GRAFSTNSMG

SEQ ID NO: 30 - protein, 10 aa, Artificial Sequence
  Synthetic polymer
GSIISINSMG

SEQ ID NO: 31 - protein, 10 aa, Artificial Sequence
  Synthetic polymer
RNFFSINAMG

SEQ ID NO: 32 - protein, 10 aa, Artificial Sequence
  Synthetic polymer
GSIVSINSMG

SEQ ID NO: 33 - protein, 10 aa, Artificial Sequence
  Synthetic polymer
GSIIGINSMG

SEQ ID NO: 34 - protein, 10 aa, Artificial Sequence
  Synthetic polymer
GRTFPGYVMA

SEQ ID NO: 35 - protein, 10 aa, Artificial Sequence
  Synthetic polymer
GRTFSINAMG

SEQ ID NO: 36 - protein, 10 aa, Artificial Sequence
  Synthetic polymer
GRTLSSYTIG

SEQ ID NO: 37 - protein, 10 aa, Artificial Sequence
  Synthetic polymer
GSFFSINAMG

SEQ ID NO: 38 - protein, 10 aa, Artificial Sequence
  Synthetic polymer
GSIFSINSMG

SEQ ID NO: 39 - protein, 10 aa, Artificial Sequence
  Synthetic polymer
GSIFSFNAMG

SEQ ID NO: 40 - protein, 10 aa, Artificial Sequence
  Synthetic polymer
GRTFSTYAMA

SEQ ID NO: 41 - protein, 10 aa, Artificial Sequence
  Synthetic polymer
VNIGSLNSMV

SEQ ID NO: 42 - protein, 10 aa, Artificial Sequence
  Synthetic polymer
GRTLSNYAVG

SEQ ID NO: 43 - protein, 10 aa, Artificial Sequence
  Synthetic polymer
GSVFSINAMG

SEQ ID NO: 44 - protein, 10 aa, Artificial Sequence
  Synthetic polymer
GSIFEINSIG

SEQ ID NO: 45 - protein, 10 aa, Artificial Sequence
  Synthetic polymer
GSIFNINSMG

SEQ ID NO: 46 - protein, 10 aa, Artificial Sequence
  Synthetic polymer
VNIGTLNSMA

SEQ ID NO: 47 - protein, 10 aa, Artificial Sequence
  Synthetic polymer
GRIGSINSMG

SEQ ID NO: 48 - protein, 10 aa, Artificial Sequence
  Synthetic polymer
GRTLSNYAVA

SEQ ID NO: 49 - protein, 10 aa, Artificial Sequence
  Synthetic polymer
RSFFSFNAMG

SEQ ID NO: 50 - protein, 10 aa, Artificial Sequence
  Synthetic polymer
GIIFSINAMG

SEQ ID NO: 51 - protein, 10 aa, Artificial Sequence
  Synthetic polymer
GRIFSVNAMG

SEQ ID NO: 52 - protein, 10 aa, Artificial Sequence
  Synthetic polymer
GRTFSSYAMA

SEQ ID NO: 53 - protein, 10 aa, Artificial Sequence
  Synthetic polymer
GSFSSINVMG

SEQ ID NO: 54 - protein, 5 aa, Artificial Sequence
  Synthetic polymer
INSMG

SEQ ID NO: 55 - protein, 5 aa, Artificial Sequence
  Synthetic polymer
INAMG

SEQ ID NO: 56 - protein, 5 aa, Artificial Sequence
  Synthetic polymer
VNAMG

SEQ ID NO: 57 - protein, 5 aa, Artificial Sequence
  Synthetic polymer
INAWG

SEQ ID NO: 58 - protein, 5 aa, Artificial Sequence
  Synthetic polymer
LNSMA

SEQ ID NO: 59 - protein, 5 aa, Artificial Sequence
  Synthetic polymer
VNSMA

SEQ ID NO: 60 - protein, 5 aa, Artificial Sequence
  Synthetic polymer
IDAMG

SEQ ID NO: 61 - protein, 5 aa, Artificial Sequence
  Synthetic polymer
IAAMG

SEQ ID NO: 62 - protein, 6 aa, Artificial Sequence
  Synthetic polymer
SITAMG

SEQ ID NO: 63 - protein, 5 aa, Artificial Sequence
  Synthetic polymer
DYAIG

SEQ ID NO: 64 - protein, 5 aa, Artificial Sequence
  Synthetic polymer
SYFMG

SEQ ID NO: 65 - protein, 5 aa, Artificial Sequence
  Synthetic polymer
INAIG

SEQ ID NO: 66 - protein, 5 aa, Artificial Sequence
  Synthetic polymer
FNAMG

SEQ ID NO: 67 - protein, 5 aa, Artificial Sequence
  Synthetic polymer
INGMA

SEQ ID NO: 68 - protein, 5 aa, Artificial Sequence
  Synthetic polymer
TYAMG

SEQ ID NO: 69 - protein, 5 aa, Artificial Sequence
  Synthetic polymer
TNSMG

SEQ ID NO: 70 - protein, 5 aa, Artificial Sequence
  Synthetic polymer
GYVMA

SEQ ID NO: 71 - protein, 5 aa, Artificial Sequence
  Synthetic polymer
SYTIG

SEQ ID NO: 72 - protein, 5 aa, Artificial Sequence
  Synthetic polymer
TYAMA

SEQ ID NO: 73 - protein, 5 aa, Artificial Sequence
  Synthetic polymer
LNSMV

SEQ ID NO: 74 - protein, 5 aa, Artificial Sequence
  Synthetic polymer
NYAVG

SEQ ID NO: 75 - protein, 5 aa, Artificial Sequence
  Synthetic polymer
INSIG

SEQ ID NO: 76 - protein, 5 aa, Artificial Sequence
  Synthetic polymer
NYAVA

SEQ ID NO: 77 - protein, 5 aa, Artificial Sequence
  Synthetic polymer
SYAMA

SEQ ID NO: 78 - protein, 5 aa, Artificial Sequence
  Synthetic polymer
INVMG

SEQ ID NO: 79 - protein, 16 aa, Artificial Sequence
  Synthetic polymer
AITNGGAKTYADSVKG

SEQ ID NO: 80 - protein, 16 aa, Artificial Sequence
  Synthetic polymer
AITSGGRLSYADSVKG

SEQ ID NO: 81 - protein, 16 aa, Artificial Sequence
  Synthetic polymer
AITNGGQTAYADSVKG

SEQ ID NO: 82 - protein, 16 aa, Artificial Sequence
  Synthetic polymer
AITSGGRSTYIDSAKG

SEQ ID NO: 83 - protein, 16 aa, Artificial Sequence
  Synthetic polymer
AITNQGRIAYAPSVNG

SEQ ID NO: 84 - protein, 16 aa, Artificial Sequence
  Synthetic polymer
AITNDGRTTYVDSVKG

SEQ ID NO: 85 - protein, 16 aa, Artificial Sequence
  Synthetic polymer
AVTVGGRYAYADSAKN

SEQ ID NO: 86 - protein, 16 aa, Artificial Sequence
  Synthetic polymer
AITNQGATTYADSVKG

SEQ ID NO: 87 - protein, 16 aa, Artificial Sequence
  Synthetic polymer
GITGSGQITYANSVRG

SEQ ID NO: 88 - protein, 16 aa, Artificial Sequence
  Synthetic polymer
AITNGGRTVYGDSVKG

SEQ ID NO: 89 - protein, 16 aa, Artificial Sequence
  Synthetic polymer
AITSGGRLAYAPSVNG

SEQ ID NO: 90 - protein, 16 aa, Artificial Sequence
  Synthetic polymer
AITNGGRTTYVDSVKG

SEQ ID NO: 91 - protein, 16 aa, Artificial Sequence
  Synthetic polymer
AITTGGRTTYVDSVKG

SEQ ID NO: 92 - protein, 16 aa, Artificial Sequence
  Synthetic polymer
AITNQGRLTYADSVKG

SEQ ID NO: 93 - protein, 16 aa, Artificial Sequence
  Synthetic polymer
AITSGGRRAYADSVKG

SEQ ID NO: 94 - protein, 18 aa, Artificial Sequence
  Synthetic polymer
AITSASASRTTYADSVKG

SEQ ID NO: 95 - protein, 17 aa, Artificial Sequence
  Synthetic polymer
CISRSDGSTYYDDSVKG

SEQ ID NO: 96 - protein, 16 aa, Artificial Sequence
  Synthetic polymer
AITNQGRVTYADSVKG

SEQ ID NO: 97 - protein, 16 aa, Artificial Sequence
  Synthetic polymer
AITDGGRLAYADSAKG

SEQ ID NO: 98 - protein, 16 aa, Artificial Sequence
  Synthetic polymer
SITNQGIRNYSTSVMG

SEQ ID NO: 99 - protein, 16 aa, Artificial Sequence
  Synthetic polymer
AITNQGRTTYADSVKG

SEQ ID NO: 100 - protein, 16 aa, Artificial Sequence
  Synthetic polymer
AITNGGRIAYGIAVNG

SEQ ID NO: 101 - protein, 16 aa, Artificial Sequence
  Synthetic polymer
AITNGGRIAYSDSAKG

SEQ ID NO: 102 - protein, 16 aa, Artificial Sequence
  Synthetic polymer
GITSDGSTGYADSVKG

SEQ ID NO: 103 - protein, 17 aa, Artificial Sequence
  Synthetic polymer
AISWSGGSTYYADSVKG

SEQ ID NO: 104 - protein, 16 aa, Artificial Sequence
  Synthetic polymer
AITDQGRLAYADSAKG

SEQ ID NO: 105 - protein, 16 aa, Artificial Sequence
  Synthetic polymer
AITNGGQTTYADSVKG

SEQ ID NO: 106 - protein, 16 aa, Artificial Sequence
  Synthetic polymer
AITTGGRTAYVDSVKG

SEQ ID NO: 107 - protein, 16 aa, Artificial Sequence
  Synthetic polymer
AITSQGRITLADSVKG

SEQ ID NO: 108 - protein, 16 aa, Artificial Sequence
  Synthetic polymer
AITVDGRLAYADSAKH

SEQ ID NO: 109 - protein, 16 aa, Artificial Sequence
  Synthetic polymer
AITNGGRIAYGTSVMG

SEQ ID NO: 110 - protein, 16 aa, Artificial Sequence
  Synthetic polymer
AITNGGQIAYADSVKG

SEQ ID NO: 111 - protein, 16 aa, Artificial Sequence
  Synthetic polymer
AITDQGRTTYADSVKG

SEQ ID NO: 112 - protein, 16 aa, Artificial Sequence
  Synthetic polymer
GITTQGRITYGNSVRG

SEQ ID NO: 113 - protein, 16 aa, Artificial Sequence
  Synthetic polymer
AITSGGRTTYVDSVKG

SEQ ID NO: 114 - protein, 17 aa, Artificial Sequence
  Synthetic polymer
AINWRGGDTYYADSVKG

SEQ ID NO: 115 - protein, 16 aa, Artificial Sequence
  Synthetic polymer
AITDGGAKTYADSVKG

SEQ ID NO: 116 - protein, 16 aa, Artificial Sequence
  Synthetic polymer
AITNQGRLSYVDSVKG

SEQ ID NO: 117 - protein, 16 aa, Artificial Sequence
  Synthetic polymer
AITNQGRRTYADSVKG

SEQ ID NO: 118 - protein, 16 aa, Artificial Sequence
  Synthetic polymer
AITNGGRIAYTDSVKG

SEQ ID NO: 119 - protein, 16 aa, Artificial Sequence
  Synthetic polymer
AITNGGRTTYADSVKG

SEQ ID NO: 120 - protein, 16 aa, Artificial Sequence
  Synthetic polymer
AITDGGRLTYADSAKG

SEQ ID NO: 121 - protein, 17 aa, Artificial Sequence
  Synthetic polymer
AISWSGGSTEYHDSVKG

SEQ ID NO: 122 - protein, 16 aa, Artificial Sequence
  Synthetic polymer
AITNQGRIAYADSVKG

SEQ ID NO: 123 - protein, 17 aa, Artificial Sequence
  Synthetic polymer
AINWSSGGISYSNSAKG

SEQ ID NO: 124 - protein, 16 aa, Artificial Sequence
  Synthetic polymer
AITGQGRTTYADSVKG

SEQ ID NO: 125 - protein, 16 aa, Artificial Sequence
  Synthetic polymer
AITNGGQIVYADSVKG

SEQ ID NO: 126 - protein, 16 aa, Artificial Sequence
  Synthetic polymer
AITTQGRTTYEDSVKG

SEQ ID NO: 127 - protein, 16 aa, Artificial Sequence
  Synthetic polymer
AITSGGITNYANSVQG

SEQ ID NO: 128 - protein, 16 aa, Artificial Sequence
  Synthetic polymer
AITVGGRLAYADSAKG

SEQ ID NO: 129 - protein, 16 aa, Artificial Sequence
  Synthetic polymer
GITGGGQITYANSVRG

SEQ ID NO: 130 - protein, 16 aa, Artificial Sequence
  Synthetic polymer
AITSQGRSTYADSAKG

SEQ ID NO: 131 - protein, 16 aa, Artificial Sequence
  Synthetic polymer
AITNGGATVYADSVKG

SEQ ID NO: 132 - protein, 16 aa, Artificial Sequence
  Synthetic polymer
AITDGGRLTYADSAKN

SEQ ID NO: 133 - protein, 17 aa, Artificial Sequence
  Synthetic polymer
AINWSSGGISYSNAAKG

SEQ ID NO: 134 - protein, 16 aa, Artificial Sequence
  Synthetic polymer
  misc_feature (5)..(5): Xaa can be any naturally occurring amino acid
AITNXGRTTYADSVKG

SEQ ID NO: 135 - protein, 17 aa, Artificial Sequence
  Synthetic polymer
AIWWASGGISYANSAKG

SEQ ID NO: 136 - protein, 16 aa, Artificial Sequence
  Synthetic polymer
AITNQGAPTYADSVKG

SEQ ID NO: 137 - protein, 16 aa, Artificial Sequence
  Synthetic polymer
RITNLGLPNYADSVTG

SEQ ID NO: 138 - protein, 16 aa, Artificial Sequence
  Synthetic polymer
RITNLGLPNYADSVKG

SEQ ID NO: 139 - protein, 9 aa, Artificial Sequence
  Synthetic polymer
AITNGGAKT

SEQ ID NO: 140 - protein, 9 aa, Artificial Sequence
  Synthetic polymer
AITSGGRLS

SEQ ID NO: 141 - protein, 9 aa, Artificial Sequence
  Synthetic polymer
AITNGGQTA

SEQ ID NO: 142 - protein, 9 aa, Artificial Sequence
  Synthetic polymer
AITSGGRST

SEQ ID NO: 143 - protein, 8 aa, Artificial Sequence
  Synthetic polymer
ITNQGRIA

SEQ ID NO: 144 - protein, 15 aa, Artificial Sequence
  Synthetic polymer
ITNQGRIAYAPSVNG

SEQ ID NO: 145 - protein, 9 aa, Artificial Sequence
  Synthetic polymer
AITNDGRTT

SEQ ID NO: 146 - protein, 9 aa, Artificial Sequence
  Synthetic polymer
AVTVGGRYA

SEQ ID NO: 147 - protein, 9 aa, Artificial Sequence
  Synthetic polymer
AITNQGATT

SEQ ID NO: 148 - protein, 9 aa, Artificial Sequence
  Synthetic polymer
GITGSGQIT

SEQ ID NO: 149 - protein, 9 aa, Artificial Sequence
  Synthetic polymer
AITNGGRTV

SEQ ID NO: 150 - protein, 9 aa, Artificial Sequence
  Synthetic polymer
AITSGGRLA

SEQ ID NO: 151 - protein, 9 aa, Artificial Sequence
  Synthetic polymer
AITNGGRTT

SEQ ID NO: 152 - protein, 9 aa, Artificial Sequence
  Synthetic polymer
AITTGGRTT

SEQ ID NO: 153 - protein, 9 aa, Artificial Sequence
  Synthetic polymer
AITNQGRLT

SEQ ID NO: 154 - protein, 9 aa, Artificial Sequence
  Synthetic polymer
AITSGGRRA

SEQ ID NO: 155 - protein, 11 aa, Artificial Sequence
  Synthetic polymer
AITSASASRTT

SEQ ID NO: 156 - protein, 10 aa, Artificial Sequence
  Synthetic polymer
CISRSDGSTY

SEQ ID NO: 157 - protein, 9 aa, Artificial Sequence
  Synthetic polymer
AITNQGRVT

SEQ ID NO: 158 - protein, 9 aa, Artificial Sequence
  Synthetic polymer
AITDGGRLA

SEQ ID NO: 159 - protein, 9 aa, Artificial Sequence
  Synthetic polymer
SITNQGIRN

SEQ ID NO: 160 - protein, 9 aa, Artificial Sequence
  Synthetic polymer
AITNQGRTT

SEQ ID NO: 161 - protein, 9 aa, Artificial Sequence
  Synthetic polymer
AITNGGRIA

SEQ ID NO: 162 - protein, 9 aa, Artificial Sequence
  Synthetic polymer
GITSDGSTG

SEQ ID NO: 163 - protein, 10 aa, Artificial Sequence
  Synthetic polymer
AISWSGGSTY

SEQ ID NO: 164 - protein, 9 aa, Artificial Sequence
  Synthetic polymer
AITDQGRLA

SEQ ID NO: 165 - protein, 9 aa, Artificial Sequence
  Synthetic polymer
AITNGGQTT

SEQ ID NO: 166 - protein, 9 aa, Artificial Sequence
  Synthetic polymer
AITTGGRTA

SEQ ID NO: 167 - protein, 9 aa, Artificial Sequence
  Synthetic polymer
AITSQGRIT

SEQ ID NO: 168 - protein, 9 aa, Artificial Sequence
  Synthetic polymer
AITVDGRLA

SEQ ID NO: 169 - protein, 9 aa, Artificial Sequence
  Synthetic polymer
AITNGGQIA

SEQ ID NO: 170 - protein, 9 aa, Artificial Sequence
  Synthetic polymer
AITDQGRTT

SEQ ID NO: 171 - protein, 9 aa, Artificial Sequence
  Synthetic polymer
GITTQGRIT

SEQ ID NO: 172 - protein, 9 aa, Artificial Sequence
  Synthetic polymer
AITSGGRTT

SEQ ID NO: 173 - protein, 10 aa, Artificial Sequence
  Synthetic polymer
AINWRGGDTY

SEQ ID NO: 174 - protein, 9 aa, Artificial Sequence
  Synthetic polymer
AITDGGAKT

SEQ ID NO: 175 - protein, 9 aa, Artificial Sequence
  Synthetic polymer
AITNQGRLS

SEQ ID NO: 176 - protein, 9 aa, Artificial Sequence
  Synthetic polymer
AITNQGRRT

SEQ ID NO: 177 - protein, 9 aa, Artificial Sequence
  Synthetic polymer
AITDGGRLT

SEQ ID NO: 178 - protein, 10 aa, Artificial Sequence
  Synthetic polymer
AISWSGGSTE

SEQ ID NO: 179 - protein, 9 aa, Artificial Sequence
  Synthetic polymer
AITNQGRIA

SEQ ID NO: 180 - protein, 10 aa, Artificial Sequence
  Synthetic polymer
AINWSSGGIS

SEQ ID NO: 181 - protein, 9 aa, Artificial Sequence
  Synthetic polymer
AITGQGRTT

SEQ ID NO: 182 - protein, 9 aa, Artificial Sequence
  Synthetic polymer
AITNGGQIV

SEQ ID NO: 183 - protein, 9 aa, Artificial Sequence
  Synthetic polymer
AITTQGRTT

SEQ ID NO: 184 - protein, 9 aa, Artificial Sequence
  Synthetic polymer
AITSGGITN

SEQ ID NO: 185 - protein, 9 aa, Artificial Sequence
  Synthetic polymer
AITVGGRLA

SEQ ID NO: 186 - protein, 9 aa, Artificial Sequence
  Synthetic polymer
GITGGGQIT

SEQ ID NO: 187 - protein, 9 aa, Artificial Sequence
  Synthetic polymer
AITSQGRST

SEQ ID NO: 188 - protein, 9 aa, Artificial Sequence
  Synthetic polymer
AITNGGATV

SEQ ID NO: 189 - protein, 9 aa, Artificial Sequence
  Synthetic polymer
  misc_feature (5)..(5): Xaa can be any naturally occurring amino acid
AITNXGRTT

SEQ ID NO: 190 - protein, 10 aa, Artificial Sequence
  Synthetic polymer
AIWWASGGIS

SEQ ID NO: 191 - protein, 9 aa, Artificial Sequence
  Synthetic polymer
AITNQGAPT

SEQ ID NO: 192 - protein, 9 aa, Artificial Sequence
  Synthetic polymer
RITNLGLPN

SEQ ID NO: 193 - protein, 7 aa, Artificial Sequence
  Synthetic polymer
FTRRDDY

SEQ ID NO: 194 - protein, 7 aa, Artificial Sequence
  Synthetic polymer
FQSSGID

SEQ ID NO: 195 - protein, 8 aa, Artificial Sequence
  Synthetic polymer
WAADYQQY

SEQ ID NO: 196 - protein, 8 aa, Artificial Sequence
  Synthetic polymer
WNRDRQQY

SEQ ID NO: 197 - protein, 13 aa, Artificial Sequence
  Synthetic polymer
KPTPVYGSTVGDY

SEQ ID NO: 198 - protein, 7 aa, Artificial Sequence
  Synthetic polymer
FTRDKDY

SEQ ID NO: 199 - protein, 8 aa, Artificial Sequence
  Synthetic polymer
WDRDRQQY

SEQ ID NO: 200 - protein, 7 aa, Artificial Sequence
  Synthetic polymer
FTRTDDY

SEQ ID NO: 201 - protein, 8 aa, Artificial Sequence
  Synthetic polymer
YDRSSTPY

SEQ ID NO: 202 - protein, 7 aa, Artificial Sequence
  Synthetic polymer
FTRGDDY

SEQ ID NO: 203 - protein, 7 aa, Artificial Sequence
  Synthetic polymer
LNSATTY

SEQ ID NO: 204 - protein, 7 aa, Artificial Sequence
  Synthetic polymer
YTRDEDY

SEQ ID NO: 205 - protein, 7 aa, Artificial Sequence
  Synthetic polymer
FTRDEDY

SEQ ID NO: 206 - protein, 13 aa, Artificial Sequence
  Synthetic polymer
KWYDPLVIEYYDN

SEQ ID NO: 207 - protein, 7 aa, Artificial Sequence
  Synthetic polymer
KADHNDY

SEQ ID NO: 208 - protein, 8 aa, Artificial Sequence
  Synthetic polymer
FRSGADDY

SEQ ID NO: 209 - protein, 15 aa, Artificial Sequence
  Synthetic polymer
EVPSTYSCSGFREDY

SEQ ID NO: 210 - protein, 8 aa, Artificial Sequence
  Synthetic polymer
FAASGMEY

SEQ ID NO: 211 - protein, 8 aa, Artificial Sequence
  Synthetic polymer
WTTDRQQY

SEQ ID NO: 212 - protein, 9 aa, Artificial Sequence
  Synthetic polymer
FAGWGKEDY

SEQ ID NO: 213 - protein, 7 aa, Artificial Sequence
  Synthetic polymer
FSPTGDY

SEQ ID NO: 214 - protein, 13 aa, Artificial Sequence
  Synthetic polymer
KPTPVYGSTVGDY

SEQ ID NO: 215 - protein, 13 aa, Artificial Sequence
  Synthetic polymer
KASPVYGSTVEDY

SEQ ID NO: 216 - protein, 8 aa, Artificial Sequence
  Synthetic polymer
STPRGDSY

SEQ ID NO: 217 - protein, 15 aa, Artificial Sequence
  Synthetic polymer
EAEGSGREGNFYERS

SEQ ID NO: 218 - protein, 8 aa, Artificial Sequence
  Synthetic polymer
WDRDRQQY

SEQ ID NO: 219 - protein, 7 aa, Artificial Sequence
  Synthetic polymer
FTRSDDY

SEQ ID NO: 220 - protein, 8 aa, Artificial Sequence
  Synthetic polymer
STPRGDSY

SEQ ID NO: 221 - protein, 7 aa, Artificial Sequence
  Synthetic polymer
FTRDTDY

SEQ ID NO: 222 - protein, 7 aa, Artificial Sequence
  Synthetic polymer
WTTLGTF

SEQ ID NO: 223 - protein, 8 aa, Artificial Sequence
  Synthetic polymer
WVRDGQQY

SEQ ID NO: 224 - protein, 13 aa, Artificial Sequence
  Synthetic polymer
KAIPVYGSTVEDY

SEQ ID NO: 225 - protein, 13 aa, Artificial Sequence
  Synthetic polymer
KAAATHLSTVADY

SEQ ID NO: 226 - protein, 7 aa, Artificial Sequence
  Synthetic polymer
FGRFDDY

SEQ ID NO: 227 - protein, 14 aa, Artificial Sequence
  Synthetic polymer
WGVKTGPESGSGTL

SEQ ID NO: 228 - protein, 7 aa, Artificial Sequence
  Synthetic polymer
FTRDEDY

SEQ ID NO: 229 - protein, 10 aa, Artificial Sequence
  Synthetic polymer
RLTTEYDYAY

SEQ ID NO: 230 - protein, 7 aa, Artificial Sequence
  Synthetic polymer
FTRGNDY

SEQ ID NO: 231 - protein, 7 aa, Artificial Sequence
  Synthetic polymer
FQSSGID

SEQ ID NO: 232 - protein, 7 aa, Artificial Sequence
  Synthetic polymer
FSPTDDF

SEQ ID NO: 233 - protein, 13 aa, Artificial Sequence
  Synthetic polymer
KAIPIYGSTAEDY

SEQ ID NO: 234 - protein, 7 aa, Artificial Sequence
  Synthetic polymer
FSLTDDY

SEQ ID NO: 235 - protein, 8 aa, Artificial Sequence
  Synthetic polymer
WTRDRQQY

SEQ ID NO: 236 - protein, 7 aa, Artificial Sequence
  Synthetic polymer
FTRDEDF

SEQ ID NO: 237 - protein, 14 aa, Artificial Sequence
  Synthetic polymer
EVEGSGREGNFYGA

SEQ ID NO: 238 - protein, 5 aa, Artificial Sequence
  Synthetic polymer
PGWDY

SEQ ID NO: 239 - protein, 8 aa, Artificial Sequence
  Synthetic polymer
YDRSATAY

SEQ ID NO: 240 - protein, 11 aa, Artificial Sequence
  Synthetic polymer
ASSVLSGTVDY

SEQ ID NO: 241 - protein, 8 aa, Artificial Sequence
  Synthetic polymer
FAADGMEY

SEQ ID NO: 242 - protein, 13 aa, Artificial Sequence
  Synthetic polymer
KAAASYVSTVADY

SEQ ID NO: 243 - protein, 6 aa, Artificial Sequence
  Synthetic polymer
TAKDDY

SEQ ID NO: 244 - protein, 9 aa, Artificial Sequence
  Synthetic polymer
FTGWGKEDY

SEQ ID NO: 245 - protein, 8 aa, Artificial Sequence
  Synthetic polymer
WAADYQQY

SEQ ID NO: 246 - protein, 8 aa, Artificial Sequence
  Synthetic polymer
YDRSATPY

SEQ ID NO: 247 - protein, 8 aa, Artificial Sequence
  Synthetic polymer
WARDRQQY

SEQ ID NO: 248 - protein, 8 aa, Artificial Sequence
  Synthetic polymer
WTKDRQQY

SEQ ID NO: 249 - protein, 7 aa, Artificial Sequence
  Synthetic polymer
FTRTYDY

SEQ ID NO: 250 - protein, 11 aa, Artificial Sequence
  Synthetic polymer
ASSILSGTVDY

SEQ ID NO: 251 - protein, 8 aa, Artificial Sequence
  Synthetic polymer
WAADYQQY

SEQ ID NO: 252 - protein, 13 aa, Artificial Sequence
  Synthetic polymer
KPAPVYGSTVGDY

SEQ ID NO: 253 - protein, 8 aa, Artificial Sequence
  Synthetic polymer
FAADGMEY

SEQ ID NO: 254 - protein, 6 aa, Artificial Sequence
  Synthetic polymer
FGSGGG

SEQ ID NO: 255 - protein, 11 aa, Artificial Sequence
  Synthetic polymer
ASSVLSGTADY

SEQ ID NO: 256 - protein, 7 aa, Artificial Sequence
  Synthetic polymer
VALKAEY

SEQ ID NO: 257 - protein, 15 aa, Artificial Sequence
  Synthetic polymer
EAEGSGREGNFYERS

SEQ ID NO: 258 - protein, 134 aa, Artificial Sequence
  Synthetic polymer
QVQLQESGGGLVQPGGSLRLSCAASGRISSINSMGWYRQAPGNQRELVAAITNGGAKTYADSVKGRFTISTDNAGNTVYLQMDSLRPEDTAVYYCKAFTRRDDYWGQGTQITVSSAAAYPYDVPDYGSHHHHHH

SEQ ID NO: 259 - protein, 134 aa, Artificial Sequence
  Synthetic polymer
QVQLQESGGGLVQAGGSLRLSCAASGSITSINAMGWYRQAPGKQRELVAAITSGGRLSYADSVKGRFTISRDNAESTVALQMNSLKPEDTAVYSCAAFQSSGIDWGQGTQVTVSSAAAYPYDVPDYGSHHHHHH

SEQ ID NO: 260 - protein, 135 aa, Artificial Sequence
  Synthetic polymer
QVQLQESGGGLVQPGGSLRLSCAASGRFFRVNAMGWYRQAPGKQRELVAAITNGGQTAYADSVKGRFTISKESARNTVHLQMSSLKPEDTAVYYCTIWAADYQQYWGQGTQVTVSSAAAYPYDVPDYGSHHHHHH

SEQ ID NO: 261 - protein, 135 aa, Artificial Sequence
  Synthetic polymer
QVQLQESGGGLVQAGESLRLSCAASGSSDSINAMGWYRQAPGKQRELVAAITSGGRSTYIDSAKGRATISRDNARNTAYLQMSSLKAEDTAVYYCTIWNRDRQQYWGQGTQVTVSSAAAYPYDVPDYGSHHHHHH

SEQ ID NO: 262 - protein, 140 aa, Artificial Sequence
  Synthetic polymer
QVQLQESGGGLVQSGGSLRLSCAASGSVFSINAWGWYRQAPGKQRELVAAITNQGRIAYAPSVNGRFTISRDSAKNTVYLQMNSLKPEDTAVYYCNAKPTPVYGSTVGDYWGQGTQVTVSSAAAYPYDVPDYGSHHHHHH

SEQ ID NO: 263 - protein, 134 aa, Artificial Sequence
  Synthetic polymer
QVQLQESGGGLVQAGGSLRLSCAASGSILSINSMGWYRPALGNQRELVAAITNDGRTTYVDSVKGRFTISRDNAKNTVYLQMNSLKPEDTAVYWCKAFTRDKDYWGQGTQVTVSSAAAYPYDVPDYGSHHHHHH

SEQ ID NO: 264 - protein, 135 aa, Artificial Sequence
  Synthetic polymer
  misc_feature (108)..(108): Xaa can be any naturally occurring amino acid
QVQLQESGGGLVQTGGSLRLSCAASVSISSINSMGWYRQAPGKERELVAAVTVGGRYAYADSAKNRFTISRDDAQNTVHLQMSSLRAEDTAVYYCTIWDRDRQQYWGXGTQVTVSSAAAYPYDVPDYGSHHHHHH

SEQ ID NO: 265 - protein, 134 aa, Artificial Sequence
  Synthetic polymer
QVQLQESGGGLVQPGGSLRLSCAASGRVFSINAMGWYRQAPGKQRELVAAITNQGATTYADSVKGRFTISRDTAGNTVYLQMNSLRPEDTAVHYCKAFTRTDDYWGQGTQVTVSSAAAYPYDVPDYGSHHHHHH

SEQ ID NO: 266 - protein, 135 aa, Artificial Sequence
  Synthetic polymer
QVQLQESGGGLVQAGGSLRLSCAASVNIDTLNSMAWYRQAPGKQRELVAGITGSGQITYANSVRGRFTVSRDNAKSTVYLQMNTLQPEDTAVYYCAAYDRSSTPYWGQGTQVTVSSAAAYPYDVPDYGSHHHHHH

SEQ ID NO: 267 - protein, 134 aa, Artificial Sequence
  Synthetic polymer
QVQLQESGGGLVQPGGSLRLSCAASGGISSINSMGWYRQAPGNQRELVAAITNGGRTVYGDSVKGRFTISRDSAGNTVHLQMDSLRPEDTGVYYCKAFTRGDDYWGQGTQVTVSSAAAYPYDVPDYGSHHHHHH

SEQ ID NO: 268 - protein, 134 aa, Artificial Sequence
  Synthetic polymer
QVQLQESGGGLVQPGGFLSLSCAASGSMHSVNSMAWYRQVPGKQRELVAAITSGGRLAYAPSVNGRFTISRDYAKNTIHLQMNSLEPEDTAVYYCAALNSATTYWGQGTQVTVSSAAAYPYDVPDYGSHHHHHH

SEQ ID NO: 269 - protein, 134 aa, Artificial Sequence
  Synthetic polymer
QVQLQESGGGLVQAGGSLRLSCAATGDISSINAMGWHRPARGNERELVAAITNGGRTTYVDSVKGRFTISRDNAKNTVYLQMNSLKPEDTAVYFCKAYTRDEDYWGQGTQVTVSSAAAYPYDVPDYGSHHHHHH

SEQ ID NO: 270 - protein, 134 aa, Artificial Sequence
  Synthetic polymer
QVQLQESGGGLVRAGGSLRLSCAASGSIFSIDAMGWYRPAHGEQRELVAAITTGGRTTYVDSVKGRFTISRDNAKNTVYLQMNSLKPEDTAVYFCKAFTRDEDYWGQGTQVTVSSAAAYPYDVPDYGSHHHHHH

SEQ ID NO: 271 - protein, 140 aa, Artificial Sequence
  Synthetic polymer
QVQLQESGGGLVQPGGSLRLSCAASGSIFSINAMGWYRQAPGKQRELVAAITNQGRLTYADSVKGRFTISRDNAKNTVFLQMDSLKPEDTAVYYCNAKWYDPLVIEYYDNWGQGTQVTVSSAAAYPYDVPDYGSHHHHHH

SEQ ID NO: 272 - protein, 134 aa, Artificial Sequence
  Synthetic polymer
QVQLQESGGGLVQPGGSLRLSCAASGSIFSIAAMGWYRQAPGKQRELVAAITSGGRRAYADSVKGRFTISRDNDENTVALQMNSLKPEDTDVYYCNAKADHNDYWGQGTQITVSSAAAYPYDVPDYGSHHHHHH

SEQ ID NO: 273 - protein, 137 aa, Artificial Sequence
  Synthetic polymer
QVQLQESGGGLVQPGGSLRLSCAAIGNIASITAMGWYRQAPGKQRELVAAITSASASRTTYADSVKGRFTISRDNAKNTVYLQMNSLQPEDTAVYYCKGFRSGADDYWGQGTQVTVSSAAAYPYDVPDYGSHHHHHH

SEQ ID NO: 274 - protein, 143 aa, Artificial Sequence
  Synthetic polymer
QVQLQESGGGLVQPGGSLRLSCAASGFTFDDYAIGWFRQAPGKEHEGVSCISRSDGSTYYDDSVKGRFTISSDNAKNTVYLQMNSLKPEDTAVYYCAAEVPSTYSCSGFREDYKGKGTQVTVSSAAAYPYDVPDYGSHHHHHH

SEQ ID NO: 275 - protein, 135 aa, Artificial Sequence
  Synthetic polymer
QVQLQESGGGLVQPGGSLRLSCAASGSISSINAMGWYRQAPGNQRELVAAITNQGRVTYADSVKGRFTISRDGAKNTVYLQMNSLKPEDTAVYYCKVFAASGMEYWGKGTQVTVSSAAAYPYDVPDYGSHHHHHH

SEQ ID NO: 276 - protein, 135 aa, Artificial Sequence
  Synthetic polymer
QVQLQESGGGLVQAGESLRLSCAASVSIFRSYFMGWYRQAPGKQRELVAAITDGGRLAYADSAKGRFTISREDTRNTVHLQMSSLKAEDTAVYYCTIWTTDRQQYWGQGTQVTVSSAAAYPYDVPDYGSHHHHHH

SEQ ID NO: 277 - protein, 136 aa, Artificial Sequence
  Synthetic polymer
QVQLQESGGGWVQPGGSLRLSCAATGSIVSINAIGWYRQAPGKQRELVASITNQGIRNYSTSVMGRFTISRDDVKNTVSLQMNSLKPEDSAVYYCKGFAGWGKEDYWGQGTQVTVSSAAAYPYDVPDYGSHHHHHH

SEQ ID NO: 278 - protein, 134 aa, Artificial Sequence
  Synthetic polymer
QVQLQESGGGLVQAGASLRLSCAASGSIFSINAMGWYRQAPGKQRELVAAITNQGRTTYADSVKGRFTISRDNAKNTVYLQMDSLEPEDTAIYYCKGFSPTGDYWGQGTQVTVSSAAAYPYDVPDYGSHHHHHH

SEQ ID NO: 279 - protein, 140 aa, Artificial Sequence
  Synthetic polymer
QVQLQESGGGLVQPGGSLRLSCLASRSFSSFNAMGWYRQAPGKERELVAAITNGGRIAYGIAVNGRFTISRDNAKNTVYLQMNSLKPEDTAVYYCNAKPTPVYGSTVGDYWGQGTQVTVSSAAAYPYDVPDYGSHHHHHH

SEQ ID NO: 280 - protein, 140 aa, Artificial Sequence
  Synthetic polymer
QVQLQESGGGLVQAGGSLTLSCAASGSFSSINAMGYYRQAPGKQRELVAAITNGGRIAYSDSAKGRFTISRDSAKNTMYLQMNSLKPEDTDVYYCNAKASPVYGSTVEDYWGQGTQVTVSSAAAYPYDVPDYGSHHHHHH

SEQ ID NO: 281 - protein, 135 aa, Artificial Sequence
  Synthetic polymer
QVQLQESGGGLVQPGGSLRLSCAASGTSFSINGMAWYRQAPGGQRELVGGITSDGSTGYADSVKGRFTVSRDNAKNTVYLQMNRLKPEDTAVYYCGTSTPRGDSYWGQGTQVTVSSAAAYPYDVPDYGSHHHHHH

SEQ ID NO: 282 - protein, 145 aa, Artificial Sequence
  Synthetic polymer
QVQLQESGGGLVQAGGSLRLSCAASGRTFSTYAMGWFRQAPGKERGLVAAISWSGGSTYYADSVKGRFTIFRDNAENTVYLQMNSLKPEDTAVYYCAAEAEGSGREGNFYERSWYQGQGTQVTVSSAAAYPYDVPDYGSHHHHHH

SEQ ID NO: 283 - protein, 135 aa, Artificial Sequence
  Synthetic polymer
QVQLQESGGGLVETGGSLRLSCAASGSIFSINAMGWYRQAPGKQRELVAAITDQGRLAYADSAKGRFTISRENARNTLHLQMSSLKAEDTAVYYCTIWDRDRQQYWGQGTQVTVSSAAAYPYDVPDYGSHHHHHH

SEQ ID NO: 284 - protein, 134 aa, Artificial Sequence
  Synthetic polymer
QVQLQESGGGLVQPGGSLRLSCAASGRIFDINAMGWYRQAPGKQRELVAAITNGGQTTYADSVKGRFTISRDNAGNTVYLQMNSLRPEDTAVYYCKAFTRSDDYWGQGTQVTVSSAAAYPYDVPDYGSHHHHHH

SEQ ID NO: 285 - protein, 135 aa, Artificial Sequence
  Synthetic polymer
QVQLQESGGGLVQAGGSLRLSCAASGTLFSINGMAWYRQAPGKRRELVGGITSDGSTGYADSVKGRFTISRDNAKNTAYLQMNSLKPEDTAVYYCGTSTPRGDSYWGQGTQVTVSSAAAYPYDVPDYGSHHHHHH

SEQ ID NO: 286 - protein, 134 aa, Artificial Sequence
  Synthetic polymer
QVQLQESGGGLVQAGGSLRLSCAASGSIDSINAMGWYRPALGEQRELVAAITTGGRTAYVDSVKGRFTISRDAAKNTVYLQMNSLKPEDTAVYSCKAFTRDTDYWGQGTQVTVSSAAAYPYDVPDYGSHHHHHH

SEQ ID NO: 287 - protein, 134 aa, Artificial Sequence
  Synthetic polymer
QVQLQESGGGLAQPGGSLQLSCAASGRAFSTNSMGWYRQASGKQRELVAAITSQGRITLADSVKGRFTISSDNTKNTVFLQMNSLKPEDTAVYYCNAWTTLGTFGGQGTQVTVSSAAAYPYDVPDYGSHHHHHH

SEQ ID NO: 288 - protein, 136 aa, Artificial Sequence
  Synthetic polymer
QVQLQESGGGLVQTGESLSLSCAVASGSIISINSMGWYRQAPEKQRELVAAITVDGRLAYADSAKHRFTISKESARNTVHLHMSSLKPEDTAVYYCTIWVRDGQQYWGQGTQVTVSSAAAYPYDVPDYGSHHHHHH

SEQ ID NO: 289 - protein, 140 aa, Artificial Sequence
  Synthetic polymer
QVQLQESGGGLVQPGGSLRLSCAVSRNFFSINAMGWYRQAPGKQRELVAAITNGGRIAYGTSVMGRFTISRDDAKNTVDLQMNSLRPEDTAVYYCNAKAIPVYGSTVEDYWGQGTQVTVSSAAAYPYDVPDYGSHHHHHH

SEQ ID NO: 290 - protein, 140 aa, Artificial Sequence
  Synthetic polymer
QVQLQESGGGLVQPGGSLRLSCAASGRFFRVNAMGWYRQVPGKQRELVAAITNGGQIAYADSVKGRFTISRDSAKNTVYLQMNSLKSEDTDVYYCNAKAAATHLSTVADYWGQGTQVTVSSAAAYPYDVPDYGSHHHHHH

SEQ ID NO: 291 - protein, 136 aa, Artificial Sequence
  Synthetic polymer
QVQLQESGGGLVQPGGSLRLSCAASGSIVSINSMGWYRQAPGKQRELVAAITDQGRTTYADSVKGRFTISRDDAKNKNTVYLQMNSLKAEDTAVYACKAFGRFDDYWGQGTQVTVSSAAAYPYDVPDYGSHHHHHH

SEQ ID NO: 292 - protein, 141 aa, Artificial Sequence
  Synthetic polymer
QVQLQESGGGLVQPGGSLRLSCAAYGSIFSINAMGWYRQAPGKERELVAGITTQGRITYGNSVRGRFTISGDNAKNTVYLQMKSLKPEDTAVYYCSAWGVKTGPESGSGTLEGQGTQVTVSSAAAYPYDVPDYGSHHHHHH

SEQ ID NO: 293 - protein, 134 aa, Artificial Sequence
  Synthetic polymer
QVQLQESGGGLVQAGGSLRLSCAASGSIIGINSMGYYRTAPGKQRELVAAITSGGRTTYVDSVKGRFTISRDNAKNTVYLQMNSLKPEDTAVYFCKAFTRDEDYWGQGTQVTVSSAAAYPYDVPDYGSHHHHHH

SEQ ID NO: 294 - protein, 138 aa, Artificial Sequence
  Synthetic polymer
QVQLQESGGGLVQAGGSLRLSCAASGRTFPGYVMAWFRQSPGQEREFAAAINWRGGDTYYADSVKGRFTISRDNVKNTVFLQMNSLKPEDTAVYFCAARLTTEYDYAYWGQGTQVTVSSAAAYPYDVPDYGSHHHHHH

SEQ ID NO: 295 - protein, 134 aa, Artificial Sequence
  Synthetic polymer
QVQLQESGGGLVQPGESLRLSCAASGSIFSINAMGWYRQAPGKQRELVAAITDGGAKTYADSVKGRFTISTDNAGNTVYLQMDSLRPEDTAVYYCKAFTRGNDYWGQGTQVTVSSAAAYPYDVPDYGSHHHHHH

SEQ ID NO: 296 - protein, 134 aa, Artificial Sequence
  Synthetic polymer
QVQLQESGGGLVQAGESLRLSCVVSGRTFSINAMGWYRQAPGKQRELVAAITNQGRLSYVDSVKGRFTISRDNAANTVYLQMNSLKPEDTAVYYCAAFQSSGIDWGQGTQVTVSSAAAYPYDVPDYGSHHHHHH

SEQ ID NO: 297 - protein, 134 aa, Artificial Sequence
  Synthetic polymer
QVQLQESGGGLVQAGGSLRLSCAASGRTLSSYTIGWYRQAPGKQRELVAAITNQGRRTYADSVKGRFTISRDNAKNTVYLQMDSLKSEDTAVYYCKGFSPTDDFWGQGTQVTVSSAAAYPYDVPDYGSHHHHHH

SEQ ID NO: 298 - protein, 140 aa, Artificial Sequence
  Synthetic polymer
QVQLQESGGGLVQPGGSLRLSCTASGSFFSINAMGWYRQAPGNQRELVAAITNGGRIAYTDSVKGRFTISNDNAKNTVYLQMNSLKPEDTDVYYCNAKAIPIYGSTAEDYWGQGTQVTVSSAAAYPYDVPDYGSHHHHHH

SEQ ID NO: 299 - protein, 134 aa, Artificial Sequence
  Synthetic polymer
QVQLQESGGGLVQAGGSLRLSCAASGSIFSINSMGWYRQAPGKQRELVAAITNGGRTTYADSVKGRFTISRDNAKNTVYLQMDSLKPEDTAVYYCKGFSLTDDYWGQGTQVTVSSAAAYPYDVPDYGSHHHHHH

SEQ ID NO: 300 - protein, 135 aa, Artificial Sequence
  Synthetic polymer
QVQLQESGGGLVQTGGSLRLSCAASGSIFSFNAMGWYRQAPGKQRELVAAITDGGRLTYADSAKGRFTISRENTRNTVHLQMSSLKAEDTADYYCTIWTRDRQQYWGQGTQVTVSSAAAYPYDVPDYGSHHHHHH

SEQ ID NO: 301 - protein, 134 aa, Artificial Sequence
  Synthetic polymer
QVQLQESGGGLVQAGGSLRLSCAASGSIFSINAMGWYRPALGEQRELVAAITTGGRTTYVDSVKGRFSISRDNAKNTVYLQMNSLKPEDTAVYFCKAFTRDEDFWGQGTQVTVSSAAAYPYDVPDYGSHHHHHH

SEQ ID NO: 302 - protein, 145 aa, Artificial Sequence
  Synthetic polymer
QVQLQESGGGLVQAGGSLRLSCEASGRTFSTYAMAWFRQAPGKERDLVAAISWSGGSTEYHDSVKGRFTISRDNTKNTVYLQMNSLKAEDTAVYYCAAEVEGSGREGNFYGASWYPGQGTQVTVSSAAAYPYDVPDYGSHHHHHH

SEQ ID NO: 303 - protein, 132 aa, Artificial Sequence
  Synthetic polymer
QVQLQESGGGLVQPGGSLRLSCAASGSFFSINAMGWYRQAPGKQRELVAAITNQGRIAYADSVKGRFTISRDNAKNTVYLQMNSLKPEDTAVYYCGRPGWDYWGQGTQVTVSSAAAYPYDVPDYGSHHHHHH

SEQ ID NO: 304 - protein, 135 aa, Artificial Sequence
  Synthetic polymer
QVQLQESGGGLVQAGGSLRLSCVASVNIGSLNSMVWYRQSPGKQRELVAGITGSGQITYANSVRGRFTVSRDIAKSTAYLQMNTLKPEDTAVYYCAAYDRSATAYWGQGTQVTVSSAAAYPYDVPDYGSHHHHHH

SEQ ID NO: 305 - protein, 139 aa, Artificial Sequence
  Synthetic polymer
QVQLQESGGGLVQAGGSLRVSCAASGRTLSNYAVGWWRQAPGKQREFVAAINWSSGGISYSNSAKGRFALSRDNAKNTVYLQMDSLKPEDTAVYYCAAASSVLSGTVDYWGQGTQVTVSSAAAYPYDVPDYGSHHHHHH

SEQ ID NO: 306 - protein, 135 aa, Artificial Sequence
  Synthetic polymer
QVQLQESGGGLVQPGGSLRLSCAASGSISSINAMGWYRQAPGKQRELVAAITGQGRTTYADSVKGRFTISRDGAKNTVYLQMNSLKPEDTAVYYCKVFAADGMEYWGKGTQVTVSSAAAYPYDVPDYGSHHHHHH

SEQ ID NO: 307 - protein, 140 aa, Artificial Sequence
  Synthetic polymer
QVQLQESGGGLVQPGGSLRLSCAASGRFFRVNAMGWYRQAPGKQRELVAAITNGGQIVYADSVKGRFTISRDSAKNTVYLQMNSLKSEDTAVYYCNAKAAASYVSTVADYWGQGTQVTVSSAAAYPYDVPDYGSHHHHHH

SEQ ID NO: 308 - protein, 134 aa, Artificial Sequence
  Synthetic polymer
QVQLQESGGGLVQAGGSLRLSCAASGSVFSINAMGWYRQAPEKQRELVAAITTQGRTTYEDSVKGRFTISRDGAQNTVYLQMDSLKPEDTAVYYCKAWTAKDDYWGKGTQVTVSSAAAYPYDVPDYGSHHHHHH

SEQ ID NO: 309 - protein, 136 aa, Artificial Sequence
  Synthetic polymer
QVQLQESGGGRVQPGGSLRLSCAAIGSIFEINSIGWYRQAPGKQRELVAAITSGGITNYANSVQGRSTISRDNVNNTVYLQMNSLKPEDSAVYYCKGFTGWGKEDYWGQGTQVTVSSAAAYPYDVPDYGSHHHHHH

SEQ ID NO: 310 - protein, 135 aa, Artificial Sequence
  Synthetic polymer
QVQLQESGGGLVQTGGSLRLSCAASGSIFNINSMGWYRQAPGKQRELVAAITVGGRLAYADSAKGRFTISKESARNTVHLQMSSLKPEDTAVYYCTIWAADYQQYWGQGTQVTVSSAAAYPYDVPDYGSHHHHHH

SEQ ID NO: 311 - protein, 135 aa, Artificial Sequence
  Synthetic polymer
QVQLQESGGGLVQAGGSLRLSCAASVNIGTLNSMAWYREAPGKQRELVAGITGGGQITYANSVRGRFTVSRDIAKSTAYLQMNTLKPEDTAVYYCAAYDRSATPYWGQGTQVTVSSAAAYPYDVPDYGSHHHHHH

SEQ ID NO: 312 - protein, 135 aa, Artificial Sequence
  Synthetic polymer
QVQLQESGGGLVQTGGSLRLSCAASGSIFSINSMGWYRQAPGKQRELVAAITSQGRSTYADSAKGRFTISLGNARNTVNLQMSSLKTEDTAVYYCTIWARDRQQYWGQGTQVTVSSAAAYPYDVPDYGSHHHHHH

SEQ ID NO: 313 - protein, 134 aa, Artificial Sequence
  Synthetic polymer
QVQLQESGGGLVQPGGSLRLSCAASGRIGSINSMGWYRQAPGKQREMVAAITNGGATVYADSVKGRFTISRDNAGNTVDLHMNSLRPEDSAVYYCKAFTRGDDYWGQGTQVTVSSAAAYPYDVPDYGSHHHHHH

SEQ ID NO: 314 - protein, 135 aa, Artificial Sequence
  Synthetic polymer
QVQLQESGGGLVQPGGSLKLSCAASGSIFSFNAMGWYRQAPGKQRELVAAITDGGRLTYADSAKNRFTISRENTRNTVHLQMSSLKAEDTAVYYCTIWTKDRQQYWGQGTQVTVSSAAAYPYDVPDYGSHHHHHH

SEQ ID NO: 315 - protein, 134 aa, Artificial Sequence
  Synthetic polymer
QVQLQESGGGLVQPGGSLRLSCAASGRISSINSMGWYRQAPGKQRELVAAITNGGAKTYADSVKGRFTISRDGAGNTVYLQMDNLRPEDTAVYYCKAFTRTYDYWGQGTQVTVSSAAAYPYDVPDYGSHHHHHH

SEQ ID NO: 316 - protein, 139 aa, Artificial Sequence
  Synthetic polymer
QVQLQESGGGLVQAGGSLRVSCAASGRTLSNYAVAWFRQAPGKQREFVAAINWSSGGISYSNAAKGRFALSRDNAKNTVYLQMDSLKPEDTAVYYCAAASSILSGTVDYWGQGTQVTVSSAAAYPYDVPDYGSHHHHHH

SEQ ID NO: 317 - protein, 135 aa, Artificial Sequence
  Synthetic polymer
QVQLQESGGGLVQPGGSLRLSCAASGRIGSINSMGWYRQAPGKQREMVAAITNGGATVYADSVKGRFTISRDNAGNTVDLHMNSLRPEDSAVYYCTIWAADYQQYWGQGTQVTVSSAAAYPYDVPDYGSHHHHHH

SEQ ID NO: 318 - protein, 140 aa, Artificial Sequence
  Synthetic polymer
QVQLQESGGGLVQPGGSLRLSCAASRSFFSFNAMGWYRQAPGKQRELVAAITNGGRIAYGTSVMGRFTISRDNAKNTVYLQMDSLKPEDTAVYYCNAKPAPVYGSTVGDYWGQGTQVTVSSAAAYPYDVPDYGSHHHHHH

SEQ ID NO: 319 - protein, 135 aa, Artificial Sequence
  Synthetic polymer
QVQLQESGGGLVQPGGSPRLSCAASGRFFRVNAMGWYRQAPGKQRELVAAITNGGQTAYADSVKGRFTISRDSAKNTVYLQMNSLKSEDTAVYYCKVFAADGMEYWGKGTQVTVSSAAAYPYDVPDYGSHHHHHH

SEQ ID NO: 320 - protein, 133 aa, Artificial Sequence
  Synthetic polymer
  misc_feature (54)..(54): Xaa can be any naturally occurring amino acid
QVQLQESGGGLVQPGESLRLSCAASGIIFSINAMGWYRQAPGKQRELVAAITNXGRTTYADSVKGRFTISRDNAKNTVTLQMNSLKPEDTAVYYCNAFGSGGGVGQGTQVTVSSAAAYPYDVPDYGSHHHHHH

SEQ ID NO: 321 - protein, 139 aa, Artificial Sequence
  Synthetic polymer
QVQLQESGGGLVQAGGSLRLSCAASGRTLSNYAVAWFRQAPGKQRELVAAIWWASGGISYANSAKGRFVLSRDNAKNTVYLQMDSLKPEDTAVYYCAAASSVLSGTADYWGQGTQVTVSSAAAYPYDVPDYGSHHHHHH

SEQ ID NO: 322 - protein, 134 aa, Artificial Sequence
  Synthetic polymer
QVQLQESGGGLVQPGGSLRLSCAASGRIFSVNAMGWYRQAPGKQRELVAAITNQGAPTYADSVKGRFTISRDNAGNTVYLQMNSLRPEDTAVYYCKAFTRGDDYWGQGTQVTVSSAAAYPYDVPDYGSHHHHHH

SEQ ID NO: 323 - protein, 145 aa, Artificial Sequence
  Synthetic polymer
QVQLQESGGGSVQAGGSLRLSCAASGRTFSSYAMAWFRQAPGMERELVAAISWSGGSTYYADSVKGRFTISRDNAENTVYLQMNSLKPEDTAVYYCAAEAEGSGREGNFYERSWYQGQGTQVTVSSAAAYPYDVPDYGSHHHHHH

SEQ ID NO: 324 - protein, 6 aa, Artificial Sequence
  Synthetic polymer
HHHHHH

SEQ ID NO: 325 - protein, 10 aa, Artificial Sequence
  Synthetic polymer
YPYDVPDYGS

SEQ ID NO: 326 - protein, 19 aa, Artificial Sequence
  Synthetic polymer
AAAYPYDVPDYGSHHHHHH

SEQ ID NO: 327 - protein, 115 aa, Artificial Sequence
  Synthetic polymer
QVQLVESGGGLVHPGGSLRLSCAASGSFSSINVMGWYRQAPGKERELVARITNLGLPNYADSVTGRFTISRDNAKNTVYLQMNSLKPEDTAVYYCYLVALKAEYWGQGTQVTVSS

SEQ ID NO: 328 - protein, 115 aa, Artificial Sequence
  Synthetic polymer
DVQLVESGGGLVHPGGSLRLSCAASGSFSSINVMGWYRQAPGKERELVARITNLGLPNYADSVTGRFTISRDNSKNTVYLQMNSLRPEDTAVYYCYLVALKAEYWGQGTLVTVSS

SEQ ID NO: 329 - protein, 115 aa, Artificial Sequence
  Synthetic polymer
DVQLVESGGGLVQPGGSLRLSCAASGSFSSINVMGWYRQAPGKERELVARITNLGLPNYADSVTGRFTISRDNSKNTVYLQMNSLRPEDTAVYYCYLVALKAEYWGQGTLVTVSS

SEQ ID NO: 330 - protein, 115 aa, Artificial Sequence
  Synthetic polymer
DVQLVESGGGLVHPGGSLRLSCAASGSFSSINVMGWYRQAPGKERELVARITNLGLPNYADSVKGRFTISRDNSKNTVYLQMNSLRPEDTAVYYCYLVALKAEYWGQGTLVTVSS

SEQ ID NO: 331 - protein, 115 aa, Artificial Sequence
  Synthetic polymer
DVQLVESGGGLVQPGGSLRLSCAASGSFSSINVMGWYRQAPGKERELVARITNLGLPNYADSVKGRFTISRDNSKNTVYLQMNSLRPEDTAVYYCYLVALKAEYWGQGTLVTVSS

SEQ ID NO: 332 - protein, 115 aa, Artificial Sequence
  Synthetic polymer
QVQLQESGGGLVQPGGSLRLSCAASGRIFSVNAMGWYRQAPGKQRELVAAITNQGAPTYADSVKGRFTISRDNAGNTVYLQMNSLRPEDTAVYYCKAFTRGDDYWGQGTQVTVSS

SEQ ID NO: 333 - protein, 115 aa, Artificial Sequence
  Synthetic polymer
DVQLVESGGGLVQPGGSLRLSCAASGRIFSVNAMGWYRQAPGKQRELVAAITNQGAPTYADSVKGRFTISRDNAGNTVYLQMNSLRPEDTAVYYCKAFTRGDDYWGQGTLVTVSS

SEQ ID NO: 334 - protein, 115 aa, Artificial Sequence
  Synthetic polymer
DVQLVESGGGLVQPGGSLRLSCAASGRIFSVNAMGWYRQAPGKQRELVAAITNQGAPTYADSVKGRFTISRDNSGNTVYLQMNSLRPEDTAVYYCKAFTRGDDYWGQGTLVTVSS

SEQ ID NO: 335 - protein, 115 aa, Artificial Sequence
  Synthetic polymer
DVQLVESGGGLVQPGGSLRLSCAASGRIFSVNAMGWYRQAPGKQRELVAAITNQGAPTYADSVKGRFTISRDNAKNTVYLQMNSLRPEDTAVYYCKAFTRGDDYWGQGTLVTVSS

SEQ ID NO: 336 - protein, 115 aa, Artificial Sequence
  Synthetic polymer
DVQLVESGGGLVQPGGSLRLSCAASGRIFSVNAMGWYRQAPGKQRELVAAITNQGAPTYADSVKGRFTISRDNSKNTVYLQMNSLRPEDTAVYYCKAFTRGDDYWGQGTLVTVSS

SEQ ID NO: 337 - protein, 165 aa, Artificial Sequence
  Synthetic polymer
CDLPQTHSLGSRRTLMLLAQMRKISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 338 - protein, 165 aa, Artificial Sequence [sequence omitted]

SEQ ID NO: 339 - protein, 166 aa, Artificial Sequence
  Synthetic polymer
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 340 - protein, 166 aa, Artificial Sequence
  Synthetic polymer
MKYTSYILAFQLCIVLGSLGCYCQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 341 - protein, 143 aa, Artificial Sequence
  Synthetic polymer
QDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 342 - protein, 167 aa, Artificial Sequence
  Synthetic polymer
MCDLPQTHSLGNRRALILLAQMRRISPFSCLKDRHDFGFPQEEFDGNQFQKAQAISVLHEMIQQTFNLFSTKDSSAAWDESLLEKFYTELYQQLNDLEACVIQEVGVEETPLMNVDSILAVKKYFQRITLYLTEKKYSPCAWEVVRAEIMRSFSLSTNLQERLRRKE

SEQ ID NO: 343 - protein, 166 aa, Artificial Sequence
  Synthetic polymer
CDLPQTHSLGNRRALILLAQMRRISPFSCLKDRHDFGFPQEEFDGNQFQKAQAISVLHEMIQQTFNLFSTKDSSAAWDESLLEKFYTELYQQLNDLEACVIQEVGVEETPLMNVDSILAVKKYFQRITLYLTEKKYSPCAWEVVRAEIMRSFSLSTNLQERLRRKE

SEQ ID NO: 344 - protein, 166 aa, Artificial Sequence
  Synthetic polymer
CDLPQTHSLGNRRTLMLLAQMRRISPFSCLKDRHDFGFPQEEFDGNQFQKAQAISVLHEMIQQTFNLFSTKDSSAAWDESLLEKFYTELYQQLNDLEACVIQEVGVEETPLMNVDSILAVKKYFQRITLYLTEKKYSPCAWEVVRAEIMRSFSLSTNLQERLRRKE

SEQ ID NO: 345 - protein, 166 aa, Artificial Sequence
  Synthetic polymer
CDLPQTHSLGNRRALILLAQMRRISPFSCLKDRHDFGFPQEEFDGNQFQKAQAISVLHEMIQQTFNLFSTKDSSAAWDESLLEKFYTELYQQLNDLEACVIQEVGVEETPLMNEDSILAVRKYFQRITLYLTEKKYSPCAWEVVRAEIMRSFSLSTNLQERLRRKE

SEQ ID NO: 346 - protein, 167 aa, Artificial Sequence
  Synthetic polymer
MCDLPQTHSLGNRRALILLAQMRRISPFSCLKDRHDFGFPQEEFDGNQFQKAQAISVLHEMIQQTFNLFSTKDSSAAWDESLLEKFYTELYQQLNDLEACVIQEVGVEETPLMNEDSILAVRKYFQRITLYLTEKKYSPCAWEVVRAEIMRSFSLSTNLQERLRRKE

SEQ ID NO: 347 - protein, 167 aa, Artificial Sequence
  Synthetic polymer
MCDLPQTHSLGNRRALILLAQMRRISPFSCLKDRHDFGFPQEEFDGNQFQKAQAISVLHEMIQQTFNLFSTKDSSAAWDESLLEKFYTELYQQLNDLEACVIQEVGVEETPLMNEDSILAVRKYFQRITLYLTEKKYSPCAWEVVRAEIMRSFSLCTNLQERLRRKE

SEQ ID NO: 348 - protein, 6 aa, Artificial Sequence
  Synthetic polymer
EEFGNQ

SEQ ID NO: 349 - protein, 7 aa, Artificial Sequence
  Synthetic polymer
EEFDGNQ

SEQ ID NO: 350 - protein, 165 aa, Artificial Sequence
  Synthetic polymer
APMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 351 - protein, 165 aa, Artificial Sequence
  Synthetic polymer
APMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRSLTRKD

SEQ ID NO: 352 - protein, 157 aa, Artificial Sequence [sequence omitted]

SEQ ID NO: 353 - protein, 171 aa, Artificial Sequence
  Synthetic polymer
LPGVGLTPSAAQTARQHPKMHLAHSNLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 354 - protein, 281 aa, Artificial Sequence [sequence omitted]

SEQ ID NO: 355 - protein, 153 aa, Artificial Sequence
  Synthetic polymer
APVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 356 - protein, 133 aa, Artificial Sequence [sequence omitted]

SEQ ID NO: 357 - protein, 129 aa, Artificial Sequence [sequence omitted]

SEQ ID NO: 358 - protein, 185 aa, Artificial Sequence
  Synthetic polymer
APVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLTTKLQAQNQWLQDMTTHLILRSFKEFLQSSLRALRQM

SEQ ID NO: 359 - protein, 114 aa, Artificial Sequence
  Synthetic polymer
SPGPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFN

SEQ ID NO: 360 - protein, 194 aa, Artificial Sequence
  Synthetic polymer
MAAEPVEDNCINFVAMKFIDNTLYFIAEDDENLESDYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNEDL

SEQ ID NO: 361 - protein, 270 aa, Artificial Sequence
  Synthetic polymer
MKPKMKYSTNKISTAKWKNTASKALCFKLGKSQQKAKEVCPMYFMKLRSGLMIKKEACYFRRETTKRPSLKTGRKHKRHLVLAACQQQSTVECFAFGISGVQKYTRALHDSSITGISPITEYLASLSTYNDQSITFALEDESYEIYVEDLKKDEKKDKVLLSYYESQHPSNESGDGVDGKMLMVTLSPTKDFWLHANNKEHSVELHKCEKPLPDQAFFVLHNMHSNCVSFECKTDPGVFIGVKDNHLALIKVDSSENLCTENILFKLSET

SEQ ID NO: 362 - protein, 10 aa, Artificial Sequence
  Synthetic polymer
GFTFDDYAMS

SEQ ID NO: 363 - protein, 17 aa, Artificial Sequence
  Synthetic polymer
TINWNGGSAEYAEPVKG

SEQ ID NO: 364 - protein, 17 aa, Artificial Sequence
  Synthetic polymer
CIRVSDGSTYYADPVKG

SEQ ID NO: 365 - protein, 11 aa, Artificial Sequence
  Synthetic polymer
KDADLVWYNLS

SEQ ID NO: 366 - protein, 11 aa, Artificial Sequence
  Synthetic polymer
KDADLVWYNLR

SEQ ID NO: 367 - protein, 24 aa, Artificial Sequence
  Synthetic polymer
AGSLYTCVQSIVVVPARPYYDMDY

SEQ ID NO: 368 - protein, 132 aa, Artificial Sequence
  Synthetic polymer
QVQLQESGGGSVQPGGSLRLSCAASGFTFDDYAMSWVRQVPGKGLEWVSTINWNGGSAEYAEPVKGRFTISRDNAKNTVYLQMNSLKLEDTAVYYCAKDADLVWYNLSTGQGTQVTVSSAAAYPYDVPDYGS

SEQ ID NO: 369 - protein, 132 aa, Artificial Sequence
  Synthetic polymer
QVQLQESGGGLVQPGGSLRLSCAASGFTFDDYAMSWVRQVPGKGLEWVSTINWNGGSAEYAEPVKGRFTISRDNAKNTVYLQMNSLKLEDTAVYYCAKDADLVWYNLRTGQGTQVTVSSAAAYPYDVPDYGS

SEQ ID NO: 370 - protein, 145 aa, Artificial Sequence
  Synthetic polymer
QVQLQESGGGLVQAGGSLRLSCAASGFTFDDYAIGWFRQAPGKEREGVSCIRVSDGSTYYADPVKGRFTISSDNAKNTVYLQMNSLKPEDAAVYYCAAGSLYTCVQSIVVVPARPYYDMDYWGKGTQVTVSSAAAYPYDVPDYGS

SEQ ID NO: 371 - protein, 10 aa, Artificial Sequence
  Synthetic polymer
GRSFSSYTLA

SEQ ID NO: 372 - protein, 10 aa, Artificial Sequence
  Synthetic polymer
GRTFSSYTMG

SEQ ID NO: 373 - protein, 10 aa, Artificial Sequence
  Synthetic polymer
GRTFSSYIMG

SEQ ID NO: 374 - protein, 10 aa, Artificial Sequence
  Synthetic polymer
GRTFSSYTMG

SEQ ID NO: 375 - protein, 14 aa, Artificial Sequence
  Synthetic polymer
GRTSGRTFSSYTMG

SEQ ID NO: 376 - protein, 10 aa, Artificial Sequence
  Synthetic polymer
GRTFSSYAMG

SEQ ID NO: 377 - protein, 10 aa, Artificial Sequence
  Synthetic polymer
GLTFSNYIMG

SEQ ID NO: 378 - protein, 10 aa, Artificial Sequence
  Synthetic polymer
GRTFSSYTMG

SEQ ID NO: 379 - protein, 10 aa, Artificial Sequence
  Synthetic polymer
GRTFSSDTMG

SEQ ID NO: 380 - protein, 10 aa, Artificial Sequence
  Synthetic polymer
GLTFSNYIMG

SEQ ID NO: 381 - protein, 10 aa, Artificial Sequence
  Synthetic polymer
GFTLDYYGIG

SEQ ID NO: 382 - protein, 10 aa, Artificial Sequence
  Synthetic polymer
GHTFSSYTMG

SEQ ID NO: 383 - protein, 10 aa, Artificial Sequence
  Synthetic polymer
GRTFSSYVIG

SEQ ID NO: 384 - protein, 10 aa, Artificial Sequence
  Synthetic polymer
GFAFDGYAIG

SEQ ID NO: 385 - protein, 10 aa, Artificial Sequence
  Synthetic polymer
GFAFGFFDMT

SEQ ID NO: 386 - protein, 10 aa, Artificial Sequence
  Synthetic polymer
GRTFSNYVIG

SEQ ID NO: 387 - protein, 10 aa, Artificial Sequence
  Synthetic polymer
GSIFSINVMG

SEQ ID NO: 388 - protein, 10 aa, Artificial Sequence
  Synthetic polymer
GRTFSNYNVG

SEQ ID NO: 389 - protein, 10 aa, Artificial Sequence
  Synthetic polymer
GHTFSSYTMG

SEQ ID NO: 390 - protein, 10 aa, Artificial Sequence
  Synthetic polymer
GRTFSTYPVG

SEQ ID NO: 391 - protein, 10 aa, Artificial Sequence
  Synthetic polymer
GRTFSNYAMG

SEQ ID NO: 392 - protein, 10 aa, Artificial Sequence
  Synthetic polymer
GRTFSDYRMG

SEQ ID NO: 393 - protein, 10 aa, Artificial Sequence
  Synthetic polymer
GLTFSNYIMA

SEQ ID NO: 394 - protein, 10 aa, Artificial Sequence
  Synthetic polymer
GRTFSNSVMG

SEQ ID NO: 395 - protein, 10 aa, Artificial Sequence
  Synthetic polymer
GRTFSSYIIG

SEQ ID NO: 396 - protein, 10 aa, Artificial Sequence
  Synthetic polymer
GRTFSSYVMG

SEQ ID NO: 397 - protein, 10 aa, Artificial Sequence
  Synthetic polymer
GGTFSNYVMG

SEQ ID NO: 398 - protein, 10 aa, Artificial Sequence
  Synthetic polymer
GRTFSNYGIG

SEQ ID NO: 399 - protein, 10 aa, Artificial Sequence
  Synthetic polymer
GFTFDDYAIA

SEQ ID NO: 400 - protein, 10 aa, Artificial Sequence
  Synthetic polymer
GRTFSSYTVA

SEQ ID NO: 401 - protein, 10 aa, Artificial Sequence
  Synthetic polymer
GFPFDDYAIA

SEQ ID NO: 402 - protein, 10 aa, Artificial Sequence
  Synthetic polymer
GRTFSSYVMG

SEQ ID NO: 403 - protein, 10 aa, Artificial Sequence
  Synthetic polymer
GRTLSSNPMA

SEQ ID NO: 404 - protein, 10 aa, Artificial Sequence
  Synthetic polymer
GFTFDNYAIG

SEQ ID NO: 405 - protein, 10 aa, Artificial Sequence
  Synthetic polymer
GRAFSSYFMG

SEQ ID NO: 406 - protein, 10 aa, Artificial Sequence
  Synthetic polymer
TPTFSSYNMG

SEQ ID NO: 407 - protein, 10 aa, Artificial Sequence
  Synthetic polymer
GFTFDDYAIA

SEQ ID NO: 408 - protein, 10 aa, Artificial Sequence
  Synthetic polymer
GGTFSGYIMG

SEQ ID NO: 409 - protein, 10 aa, Artificial Sequence
  Synthetic polymer
GRSFSSYTIA

SEQ ID NO: 410 - protein, 10 aa, Artificial Sequence
  Synthetic polymer
GFSSDDYTIG

SEQ ID NO: 411 - protein, 10 aa, Artificial Sequence
  Synthetic polymer
GFTFDDYTIG

SEQ ID NO: 412 - protein, 10 aa, Artificial Sequence
  Synthetic polymer
GFSSDDYTIG

SEQ ID NO: 413 - protein, 10 aa, Artificial Sequence
  Synthetic polymer
GFTFDQYTIA

SEQ ID NO: 414 - protein, 10 aa, Artificial Sequence
  Synthetic polymer
GFAFDGYAIG

SEQ ID NO: 415 - protein, 10 aa, Artificial Sequence
  Synthetic polymer
GFSSDDYTIA

SEQ ID NO: 416 - protein, 10 aa, Artificial Sequence
  Synthetic polymer
GFSSDDYTIG

SEQ ID NO: 417 - protein, 10 aa, Artificial Sequence
  Synthetic polymer
GFTFDDYTIG

SEQ ID NO: 418 - protein, 10 aa, Artificial Sequence
  Synthetic polymer
GFSSDDYTIG

SEQ ID NO: 419 - protein, 10 aa, Artificial Sequence
  Synthetic polymer
GFSSDDYTIG

SEQ ID NO: 420 - protein, 10 aa, Artificial Sequence
  Synthetic polymer
GFSFDDYAIA

SEQ ID NO: 421 - protein, 10 aa, Artificial Sequence
  Synthetic polymer
GFSSDDYTIG

SEQ ID NO: 422 - protein, 10 aa, Artificial Sequence
  Synthetic polymer
GFTGNDLAIG

SEQ ID NO: 423 - protein, 10 aa, Artificial Sequence
  Synthetic polymer
GFSSDDYTIA

SEQ ID NO: 424 - protein, 10 aa, Artificial Sequence
  Synthetic polymer
EGTLSSYGIG

SEQ ID NO: 425 - protein, 10 aa, Artificial Sequence
  Synthetic polymer
GFSSDDYTIA

SEQ ID NO: 426 - protein, 10 aa, Artificial Sequence
  Synthetic polymer
GFTFDDYAIA

SEQ ID NO: 427 - protein, 10 aa, Artificial Sequence
  Synthetic polymer
GLSSDDYTIG

SEQ ID NO: 428 - protein, 10 aa, Artificial Sequence
  Synthetic polymer
GLSSDDYTIG

SEQ ID NO: 429 - protein, 10 aa, Artificial Sequence
  Synthetic polymer
GFSSDDYTIG

SEQ ID NO: 430 - protein, 10 aa, Artificial Sequence
  Synthetic polymer
GFSFDDYTIG

SEQ ID NO: 431 - protein, 10 aa, Artificial Sequence
  Synthetic polymer
GFTFDDYAIA

SEQ ID NO: 432 - protein, 10 aa, Artificial Sequence
  Synthetic polymer
GFTFDDYAIG

SEQ ID NO: 433 - protein, 10 aa, Artificial Sequence
  Synthetic polymer
GFTFGDYTIG

SEQ ID NO: 434 - protein, 10 aa, Artificial Sequence
  Synthetic polymer
EGTFSSYGIG

SEQ ID NO: 435 - protein, 10 aa, Artificial Sequence
  Synthetic polymer
GFSSDDYTIG

SEQ ID NO: 436 - protein, 10 aa, Artificial Sequence
  Synthetic polymer
GVSIGDYNIG

SEQ ID NO: 437 - protein, 10 aa, Artificial Sequence
  Synthetic polymer
GFTFDDYTIA

SEQ ID NO: 438 - protein, 10 aa, Artificial Sequence
  Synthetic polymer
GFTFDDYTIA

SEQ ID NO: 439 - protein, 11 aa, Artificial Sequence
  Synthetic polymer
ASITWGGGNTY

SEQ ID NO: 440 - protein, 11 aa, Artificial Sequence
  Synthetic polymer
AATVWTGAGTV

SEQ ID NO: 441 - protein, 11 aa, Artificial Sequence
  Synthetic polymer
AAIGWSADITV

SEQ ID NO: 442 - protein, 11 aa, Artificial Sequence
  Synthetic polymer
AFIDWSGGGTY

SEQ ID NO: 443 - protein, 11 aa, Artificial Sequence
  Synthetic polymer
ATITWGGGSTY

SEQ ID NO: 444 - protein, 11 aa, Artificial Sequence
  Synthetic polymer
AAISWSGGPTV

SEQ ID NO: 445 - protein, 11 aa, Artificial Sequence
  Synthetic polymer
AAITWGGGSTV

SEQ ID NO: 446 - protein, 11 aa, Artificial Sequence
  Synthetic polymer
AAITWSGVSTV

SEQ ID NO: 447 - protein, 11 aa, Artificial Sequence
  Synthetic polymer
GAIMWSGAFTH

SEQ ID NO: 448 - protein, 11 aa, Artificial Sequence
  Synthetic polymer
AAITWGGGSTV

SEQ ID NO: 449 - protein, 11 aa, Artificial Sequence
  Synthetic polymer
SCISSSDRNTY

SEQ ID NO: 450 - protein, 11 aa, Artificial Sequence
  Synthetic polymer
AFIDWSGGGTY

SEQ ID NO: 451 - protein, 11 aa, Artificial Sequence
  Synthetic polymer
AVITWSGDSTY

SEQ ID NO: 452 - protein, 11 aa, Artificial Sequence
  Synthetic polymer
ACISSKDGSTY

SEQ ID NO: 453 - protein, 11 aa, Artificial Sequence
  Synthetic polymer
SGINSIGGSTT

SEQ ID NO: 454 - protein, 11 aa, Artificial Sequence
  Synthetic polymer
AVVTWSGDSTY

SEQ ID NO: 455 - protein, 10 aa, Artificial Sequence
  Synthetic polymer
AKITNFGITS

SEQ ID NO: 456 - protein, 11 aa, Artificial Sequence
  Synthetic polymer
SFISWISDITY

SEQ ID NO: 457 - protein, 11 aa, Artificial Sequence
  Synthetic polymer
AFIDWSGGGTY

SEQ ID NO: 458 - protein, 11 aa, Artificial Sequence
  Synthetic polymer
AVILWSGVSTY

SEQ ID NO: 459 - protein, 11 aa, Artificial Sequence
  Synthetic polymer
AAIVWSGGSTY

SEQ ID NO: 460 - protein, 11 aa, Artificial Sequence
  Synthetic polymer
AAISSSGYHTY

SEQ ID NO: 461 - protein, 11 aa, Artificial Sequence
  Synthetic polymer
SCISSPDGSTY

SEQ ID NO: 462 - protein, 11 aa, Artificial Sequence
  Synthetic polymer
AAVLWSGVSTA

SEQ ID NO: 463 - protein, 11 aa, Artificial Sequence
  Synthetic polymer
VAITWDGSATT

SEQ ID NO: 464 - protein, 11 aa, Artificial Sequence
  Synthetic polymer
AAIGWNGGITY

SEQ ID NO: 465 - protein, 11 aa, Artificial Sequence
  Synthetic polymer
GFITWSGASTY

SEQ ID NO: 466 - protein, 11 aa, Artificial Sequence
  Synthetic polymer
AGINWSGESAD

SEQ ID NO: 467 - protein, 11 aa, Artificial Sequence
  Synthetic polymer
SCIERSDGSTY

SEQ ID NO: 468 - protein, 11 aa, Artificial Sequence
  Synthetic polymer
SCISNTDSSTY

SEQ ID NO: 469 - protein, 11 aa, Artificial Sequence
  Synthetic polymer
SCISNTDSSTY

SEQ ID NO: 470 - protein, 11 aa, Artificial Sequence
  Synthetic polymer
AQISWSAGSIY

SEQ ID NO: 471 - protein, 11 aa, Artificial Sequence
  Synthetic polymer
AGMSWNPGPAV

SEQ ID NO: 472 - protein, 11 aa, Artificial Sequence
  Synthetic polymer
SCISRSDGSTY

SEQ ID NO: 473 - protein, 11 aa, Artificial Sequence
  Synthetic polymer
ANIGWTGDMTY

SEQ ID NO: 474 - protein, 11 aa, Artificial Sequence
  Synthetic polymer
AAIIWSGSMTY

SEQ ID NO: 475 - protein, 11 aa, Artificial Sequence
  Synthetic polymer
SCISNTDSSTY

SEQ ID NO: 476 - protein, 11 aa, Artificial Sequence
  Synthetic polymer
AANTWSGGPTY

SEQ ID NO: 477 - protein, 10 aa, Artificial Sequence
  Synthetic polymer
SCISSDGSTG

SEQ ID NO: 478 - protein, 11 aa, Artificial Sequence
  Synthetic polymer
SCYSSSDGSTG

SEQ ID NO: 479 - protein, 10 aa, Artificial Sequence
  Synthetic polymer
SCISSDGSTG

SEQ ID NO: 480 - protein, 11 aa, Artificial Sequence
  Synthetic polymer
GCIKSSDGTTG

SEQ ID NO: 481 - protein, 11 aa, Artificial Sequence
  Synthetic polymer
SCISNTDSSTY

SEQ ID NO: 482 - protein, 11 aa, Artificial Sequence
  Synthetic polymer
AAIAWSAGSTY

SEQ ID NO: 483 - protein, 11 aa, Artificial Sequence
  Synthetic polymer
SCISSKEGSTY

SEQ ID NO: 484 - protein, 11 aa, Artificial Sequence
  Synthetic polymer
SCISSSDGSTG

SEQ ID NO: 485 - protein, 11 aa, Artificial Sequence
  Synthetic polymer
SCYSSRDGTTG

SEQ ID NO: 486 - protein, 10 aa, Artificial Sequence
  Synthetic polymer
SCISSDGSTG

SEQ ID NO: 487 - protein, 11 aa, Artificial Sequence
  Synthetic polymer
SCYSSSDGSTG

SEQ ID NO: 488 - protein, 11 aa, Artificial Sequence
  Synthetic polymer
SCFSSSDGSTG

SEQ ID NO: 489 - protein, 11 aa, Artificial Sequence
  Synthetic polymer
SCISNTDSSTF

SEQ ID NO: 490 - protein, 11 aa, Artificial Sequence
  Synthetic polymer
SCYSSSDGSTG

SEQ ID NO: 491 - protein, 11 aa, Artificial Sequence
  Synthetic polymer
SCISNTDSSTY

SEQ ID NO: 492 - protein, 11 aa, Artificial Sequence
  Synthetic polymer
SCISSSDGSTG

SEQ ID NO: 493 - protein, 11 aa, Artificial Sequence
  Synthetic polymer
GGINWSGDSTD

SEQ ID NO: 494 - protein, 11 aa, Artificial Sequence
  Synthetic polymer
SCFSSSDGSAG

SEQ ID NO: 495 - protein, 11 aa, Artificial Sequence
  Synthetic polymer
SCISNTDSSTY

SEQ ID NO: 496 - protein, 11 aa, Artificial Sequence
  Synthetic polymer
SCFSTRDGNAG

SEQ ID NO: 497 - protein, 11 aa, Artificial Sequence
  Synthetic polymer
SCFSSRDGSTG

SEQ ID NO: 498 - protein, 11 aa, Artificial Sequence
  Synthetic polymer
SCFSSRDGSTG

SEQ ID NO: 499 - protein, 10 aa, Artificial Sequence
  Synthetic polymer
SCISSDGSTG

SEQ ID NO: 500 - protein, 11 aa, Artificial Sequence
  Synthetic polymer
SCISNTDSSTY

SEQ ID NO: 501 - protein, 11 aa, Artificial Sequence
  Synthetic polymer
SCISSPDGSTY

SEQ ID NO: 502 - protein, 11 aa, Artificial Sequence
  Synthetic polymer
SCYSSSDGNTG

SEQ ID NO: 503 - protein, 11 aa, Artificial Sequence
  Synthetic polymer
GGINWSGDSTD

SEQ ID NO: 504 - protein, 11 aa, Artificial Sequence
  Synthetic polymer
SCFSSSDGSTG

SEQ ID NO: 505 - protein, 11 aa, Artificial Sequence
  Synthetic polymer
SCISSGDGTTY

SEQ ID NO: 506 - protein, 10 aa, Artificial Sequence
  Synthetic polymer
SCISSDGSTG

SEQ ID NO: 507 - protein, 10 aa, Artificial Sequence
  Synthetic polymer
SCISSDGSTG

SEQ ID NO: 508 - protein, 19 aa, Artificial Sequence
  Synthetic polymer
AKGLRNSDWDLRRGYEYDY

SEQ ID NO: 509 - protein, 25 aa, Artificial Sequence
  Synthetic polymer
ADQASVPPPYGSERYDIASPSEYDY

SEQ ID NO: 510 - protein, 21 aa, Artificial Sequence
  Synthetic polymer
ANSRAYYSSSYDLGRLASYDY

SEQ ID NO: 511 - protein, 16 aa, Artificial Sequence
  Synthetic polymer
AAQRLGSVTDYTKYDY

SEQ ID NO: 512 - protein, 21 aa, Artificial Sequence
  Synthetic polymer
ASVKVVAGSGIDISGSRNYDY

SEQ ID NO: 513 - protein, 21 aa, Artificial Sequence
  Synthetic polymer
AKRLDYSATDKGVDLSDEYDY

SEQ ID NO: 514 - protein, 19 aa, Artificial Sequence
  Synthetic polymer
AAGGSGRLRDLKVGQNYDY

SEQ ID NO: 515 - protein, 23 aa, Artificial Sequence
  Synthetic polymer
ADSPPRTYSSGSVNLEDGSEYDY

SEQ ID NO: 516 - protein, 21 aa, Artificial Sequence
  Synthetic polymer
VIPGRGSALPIDVGKSDEYEY

SEQ ID NO: 517 - protein, 19 aa, Artificial Sequence
  Synthetic polymer
AAGASGRLRDLKVGQNYDY

SEQ ID NO: 518 - protein, 23 aa, Artificial Sequence
  Synthetic polymer
ADGNVWSPPICGSAGPPPGGMDY

SEQ ID NO: 519 - protein, 16 aa, Artificial Sequence
  Synthetic polymer
AAQRLGSVTDYTKYDY

SEQ ID NO: 520 - protein, 22 aa, Artificial Sequence
  Synthetic polymer
AIPPRAYSGGSYSLKDQSKYEY

SEQ ID NO: 521 - protein, 23 aa, Artificial Sequence
  Synthetic polymer
ADGNVWSPPICSSAGPPPGGMDY

SEQ ID NO: 522 - protein, 9 aa, Artificial Sequence
  Synthetic polymer
KSRSSYSNN

SEQ ID NO: 523 - protein, 22 aa, Artificial Sequence
  Synthetic polymer
AMPPRAYTGRSVSLKDQSKYEY

SEQ ID NO: 524 - protein, 13 aa, Artificial Sequence
  Synthetic polymer
LDTTGWGPPPYQY

SEQ ID NO: 525 - protein, 22 aa, Artificial Sequence
  Synthetic polymer
AHPPDPSRGGEWRLQTPSEYDY

SEQ ID NO: 526 - protein, 16 aa, Artificial Sequence
  Synthetic polymer
AAQRLGSVTDYTKYDY

SEQ ID NO: 527 - protein, 24 aa, Artificial Sequence
  Synthetic polymer
VPRSHFTTAQDMGQDMGAPSWYEY

SEQ ID NO: 528 - protein, 22 aa, Artificial Sequence
  Synthetic polymer
AVLIRYYSGGYQGLSDANEYDY

SEQ ID NO: 529 - protein, 17 aa, Artificial Sequence
  Synthetic polymer
VVKYLSGSYSYAGQYNF

SEQ ID NO: 530 - protein, 23 aa, Artificial Sequence
  Synthetic polymer
ADFNVWSPPICGSVGPPPGGMDY

SEQ ID NO: 531 - protein, 21 aa, Artificial Sequence
  Synthetic polymer
AHESTYYSGTYYLTDPRRYVY

SEQ ID NO: 532 - protein, 19 aa, Artificial Sequence
  Synthetic polymer
AVPARGLTMDLENSDIYDH

SEQ ID NO: 533 - protein, 22 aa, Artificial Sequence
  Synthetic polymer
AATLQVTGSYYLDLSTVDIYDN

SEQ ID NO: 534 - protein, 20 aa, Artificial Sequence
  Synthetic polymer
ATLFRSNGPKDLSSGYEYDY

SEQ ID NO: 535 - protein, 13 aa, Artificial Sequence
  Synthetic polymer
AGESGVWVGGLDY

SEQ ID NO: 536 - protein, 22 aa, Artificial Sequence
  Synthetic polymer
VGSANSGEFRFGWVLKPDLYNY

SEQ ID NO: 537 - protein, 23 aa, Artificial Sequence
  Synthetic polymer
ADGNVWSPPICGSAGPPPGGMDY

SEQ ID NO: 538 - protein, 23 aa, Artificial Sequence
  Synthetic polymer
ADGNVWSPPICGSAGPPPGGMDY

SEQ ID NO: 539 - protein, 20 aa, Artificial Sequence
  Synthetic polymer
ERGYAYCSDDGCQRTQDYDY

SEQ ID NO: 540 - protein, 21 aa, Artificial Sequence
  Synthetic polymer
GAARAWWSGSYDYTRMNNYDY

SEQ ID NO: 541 - protein, 23 aa, Artificial Sequence
  Synthetic polymer
AETSADSGEFRFGWVLKPSLYDY

SEQ ID NO: 542 - protein, 21 aa, Artificial Sequence
  Synthetic polymer
AAGSAYSGSYWNITMAANYDY

SEQ ID NO: 543 - protein, 18 aa, Artificial Sequence
  Synthetic polymer
AQRIFGAQPMDLSGDYEY

SEQ ID NO: 544 - protein, 23 aa, Artificial Sequence
  Synthetic polymer
ADGNVWSPPICGSAGPPPGGMDY

SEQ ID NO: 545 - protein, 18 aa, Artificial Sequence
  Synthetic polymer
ARDYRGIKDLDLKGDYDY

SEQ ID NO: 546 - protein, 25 aa, Artificial Sequence
  Synthetic polymer
ADFNVWSPPICGSIWYGPPPRGMDY

SEQ ID NO: 547 - protein, 25 aa, Artificial Sequence
  Synthetic polymer
ADSNVWSPPICGSRWYGPPPGGMAY

SEQ ID NO: 548 - protein, 25 aa, Artificial Sequence
  Synthetic polymer
ADFNVWSPPICGSNWYGPPPGGMDY

SEQ ID NO: 549 - protein, 25 aa, Artificial Sequence
  Synthetic polymer
ADFNVWSPPICGSIWYGPPPGGMDY

SEQ ID NO: 550 - protein, 23 aa, Artificial Sequence
  Synthetic polymer
ADGNVWSPPICGSAGPPPGGMDY

SEQ ID NO: 551 - protein, 17 aa, Artificial Sequence
  Synthetic polymer
ARIITVATMRLDSDYDY

SEQ ID NO: 552 - protein, 23 aa, Artificial Sequence
  Synthetic polymer
ADGNVWSPPICGSAGPPPGGMDY

SEQ ID NO: 553 - protein, 25 aa, Artificial Sequence
  Synthetic polymer
ADSNVWSPPICGRTWYGPPPGGMDY

SEQ ID NO: 554 - protein, 25 aa, Artificial Sequence
  Synthetic polymer
ADFNVWSPPICGSIWYGPPPGGMAY

SEQ ID NO: 555 - protein, 25 aa, Artificial Sequence
  Synthetic polymer
ADFNVWSPPICGSNWYGPPPGGMDY

SEQ ID NO: 556 - protein, 25 aa, Artificial Sequence
  Synthetic polymer
ADFNVWSPPICGSSWYGPPPGGMDY

SEQ ID NO: 557 - protein, 25 aa, Artificial Sequence
  Synthetic polymer
ADFNVWSPPICGSRWYGPPPGGMEY

SEQ ID NO: 558 - protein, 23 aa, Artificial Sequence
  Synthetic polymer
ADGNVWSPPICGSAGPPPGGMDY

SEQ ID NO: 559 - protein, 25 aa, Artificial Sequence
  Synthetic polymer
ADFNVWSPPICGSRWYGPPPGGMAY

SEQ ID NO: 560 - protein, 23 aa, Artificial Sequence
  Synthetic polymer
ADGNVWSPPICGSAGPPPGGMDY

SEQ ID NO: 561 - protein, 25 aa, Artificial Sequence
  Synthetic polymer
ADSNVWSPPICGKTWYGPPPGGMDY

SEQ ID NO: 562 - protein, 13 aa, Artificial Sequence
  Synthetic polymer
AGESGVWVGGLDY

SEQ ID NO: 563 - protein, 25 aa, Artificial Sequence
  Synthetic polymer
ADSNVWSPPICGSTWYGPPPGGMAY

SEQ ID NO: 564 - protein, 23 aa, Artificial Sequence
  Synthetic polymer
ADGNVWSPPICGSAGPPPGGMDY

SEQ ID NO: 565 - protein, 25 aa, Artificial Sequence
  Synthetic polymer
ADFNVWSPPICGSRWYGPPPGGMDY

SEQ ID NO: 566 - protein, 25 aa, Artificial Sequence
  Synthetic polymer
ADFNVWSPPICGSRWYGPPPGGMDY

SEQ ID NO: 567 - protein, 25 aa, Artificial Sequence
  Synthetic polymer
ADFNVWSPPICGSRWYGPPPGGMDY

SEQ ID NO: 568 - protein, 25 aa, Artificial Sequence
  Synthetic polymer
ADFNVWSPPICGSIWYGPPPGGMDY

SEQ ID NO: 569 - protein, 23 aa, Artificial Sequence
  Synthetic polymer
ADGNVWSPPICGSAGPPPGGMDY

SEQ ID NO: 570 - protein, 23 aa, Artificial Sequence
  Synthetic polymer
ADFNVWSPPICGSVGPPPGGMDY

SEQ ID NO: 571 - protein, 25 aa, Artificial Sequence
  Synthetic polymer
ADFNVWSPPICGSSWYGPPPGGMAY

SEQ ID NO: 572 - protein, 13 aa, Artificial Sequence
  Synthetic polymer
AGESGVWVGGLDY

SEQ ID NO: 573 - protein, 25 aa, Artificial Sequence
  Synthetic polymer
ADFNVWSPPICGSSWYGPPPGGMEY

SEQ ID NO: 574 - protein, 23 aa, Artificial Sequence
  Synthetic polymer
ADGNVWSPPICGSAGPPPGGMDY

SEQ ID NO: 575 - protein, 25 aa, Artificial Sequence
  Synthetic polymer
ADFNVWSPPICSSNWYGPPPRGMDY

SEQ ID NO: 576 - protein, 25 aa, Artificial Sequence
  Synthetic polymer
ADFNVWSPPICGSIWYGPPPRGMDY

SEQ ID NO: 577 - protein, 146 aa, Artificial Sequence
  Synthetic polymer
QVQLQESGGGLVQAGGSLRLSCAASGRSFSSYTLAWFRQAPGKEREFVASITWGGGNTYYPDSVKGRFTISRDDAKNTVYLQMNSLKPEDTAVYYCAAKGLRNSDWDLRRGYEYDYWGQGTQVTVSSAAAYPYDVPDYGSHHHHHH

SEQ ID NO: 578 - protein, 152 aa, Artificial Sequence
  Synthetic polymer
QVQLQESGGGLVQDGGSLRLSCAFSGRTFSSYTMGWFRQGPGKEREFVAATVWTGAGTVYADSVKGRFTISRDNAKNTVYLQMNSLRPEDTAVYYCAADQASVPPPYGSERYDIASPSEYDYWGQGTQVTVSSAAAYPYDVPDYGSHHHHHH

SEQ ID NO: 579 - protein, 148 aa, Artificial Sequence
  Synthetic polymer
QVQLQESGGGLVQAGASLRLSCAASGRTFSSYIMGWFRQAPGKEREFVAAIGWSADITVYADSVKGRFTISRDNAENMVYLQMNSLNPEDTAVYYCAANSRAYYSSSYDLGRLASYDYWGQGTQVTVSSAAAYPYDVPDYGSHHHHHH

SEQ ID NO: 580 - protein, 143 aa, Artificial Sequence
  Synthetic polymer
QVQLQESGGGLVQAGGSLRLSCAASGRTFSSYTMGWFRQAPGKEREFVAFIDWSGGGTYYDDSVKGRFTISRDNAENTVYLQMNNLEPEDTAVYYCAAAQRLGSVTDYTKYDYWGQGTQVTVSSAAAYPYDVPDYGSHHHHHH

SEQ ID NO: 581 - protein, 152 aa, Artificial Sequence
  Synthetic polymer
QVQLQESGGGLVQAGGSLRLSCAASGRTSGRTFSSYTMGWFRQAPGKEREFVATITWGGGSTYYADSVKGRFTISRDNANNTVYLQMNSLKPEDTAVYYCAASVKVVAGSGIDISGSRNYDYWGQGTQVTVSSAAAYPYDVPDYGSHHHHHH

SEQ ID NO: 582 - protein, 148 aa, Artificial Sequence
  Synthetic polymer
QVQLQESGGGLVQPGGSLRLSCLASGRTFSSYAMGWFRQAPGKEREFVAAISWSGGPTVYADHVKGRFTISRDNAKNTVYLQVNSLKPEDTADYYCAAKRLDYSATDKGVDLSDEYDYWGQGTQVTVSSAAAYPYDVPDYGSHHHHHH

SEQ ID NO: 583 - protein, 146 aa, Artificial Sequence
  Synthetic polymer
QVQLQESGGGLVQAGDSLRLSCAASGLTFSNYIMGWFRQAPGKEREFVAAITWGGGSTVYADSVEGRFTISRDGTKNTVSLQMNSLLPEDTAVYYCAAAGGSGRLRDLKVGQNYDYWGQGTQVTVSSAAAYPYDVPDYGSHHHHHH

SEQ ID NO: 584 - protein, 150 aa, Artificial Sequence
  Synthetic polymer
QVQLQESGGGLVQAGGSLRLSCAASGRTFSSYTMGWFRQAPGREREFVAAITWSGVSTVYTDSVKGRFTVSRDNAKNTVYLQMNSLKPEDTAVYYCAADSPPRTYSSGSVNLEDGSEYDYWGQGTQVTVSSAAAYPYDVPDYGSHHHHHH

SEQ ID NO: 585 - protein, 148 aa, Artificial Sequence
  Synthetic polymer
QVQLQESGGGLVQAGGSLRLSCAASGRTFSSDTMGWFRQAPGKEREFVGAIMWSGAFTHYADSVKGRFTISRDNAKNTVYLQMNALKPEDTAVYYCAVIPGRGSALPIDVGKSDEYEYWGQGTQVTVSSAAAYPYDVPDYGSHHHHHH

SEQ ID NO: 586 - protein, 146 aa, Artificial Sequence
  Synthetic polymer
QVQLQESGGGLVQAGDSLRLSCAASGLTFSNYIMGWFRQAPGKEREFVAAITWGGGSTVYADSVEGRFTISRDGTKNTVSLQMNSLQPEDTAVYYCAAAGASGRLRDLKVGQNYDYWGQGTQVTVSSAAAYPYDVPDYGSHHHHHH

SEQ ID NO: 587 - protein, 150 aa, Artificial Sequence
  Synthetic polymer
QVQLQESGGGLVQAGGSLRLSCAGSGFTLDYYGIGWFRQAPGKEREGVSCISSSDRNTYYADSVKGRFTISGDNAKNTVYLQMNNLKPEDTAVYYCAADGNVWSPPICGSAGPPPGGMDYWGKGTQVTVSSAAAYPYDVPDYGSHHHHHH

SEQ ID NO: 588 - protein, 143 aa, Artificial Sequence
  Synthetic polymer
QVQLQESGGGLVQAGGSLRLSCVASGHTFSSYTMGWFRQAPGKEREFVAFIDWSGGGTYYANSVKGRFTISRDNAENTVYLQMNNLKPEDTAVYYCAAAQRLGSVTDYTKYDYWGQGTQVTVSSAAAYPYDVPDYGSHHHHHH

SEQ ID NO: 589 - protein, 149 aa, Artificial Sequence
  Synthetic polymer
QVQLQESGGGLVQAGGSLRLSCAASGRTFSSYVIGWFRQAPGKEREFVAVITWSGDSTYSSDSLKGRFTISRDNAKNTVYLQMNALNPEDTAVYYCAAIPPRAYSGGSYSLKDQSKYEYWGQGTQVTVSSAAAYPYDVPDYGSHHHHHH

SEQ ID NO: 590 - protein, 149 aa, Artificial Sequence
  Synthetic polymer
QVQLQESGGGLVQAEGSLKLSCISGFAFDGYAIGWFRQAPGKEREGVACISSKDGSTYYADSVKGRFTMSVDKTKNTVYLQMSSLKPEDTAVYYCAADGNVWSPPICSSAGPPPGGMDYWGKGTQVTVSSAAAYPYDVPDYGSHHHHHH

SEQ ID NO: 591 - protein, 139 aa, Artificial Sequence
  Synthetic polymer
QVQLQESGGGLVQPGGSLTLSCAASGFAFGFFDMTWVRQAPGKGLEWVSGINSIGGSTTYADSVKGRFTISRDNAKNELYLQMNSLKPDDTAVYYCAKSRSSYSNNWRPPGQGTQVTVSSAAAYPYDVPDYGSHHHHHH

SEQ ID NO: 592 - protein, 149 aa, Artificial Sequence
  Synthetic polymer
QVQLQESGGGLVQARGSLTLSCAASGRTFSNYVIGWFRQAPGEEREFVAVVTWSGDSTYSSDSLKGRFTISRDNAKNTVYLQMNNLNPEDTAVYYCAAMPPRAYTGRSVSLKDQSKYEYWGQGTQVTVSSAAAYPYDVPDYGSHHHHHH

SEQ ID NO: 593 - protein, 139 aa, Artificial Sequence
  Synthetic polymer
QVQLQESGGGLVQPGGSLRLSCAASGSIFSINVMGWYRQTPGKERELVAKITNFGITSYADSAQGRFTISRGNAKNTVYLQMNSLKPEDTAVYYCNLDTTGWGPPPYQYWGQGTQVTVSSAAAYPYDVPDYGSHHHHHH

SEQ ID NO: 594 - protein, 149 aa, Artificial Sequence
  Synthetic polymer
QVQLQESGGGLVQAGASLRLSCAASGRTFSNYNVGWFRQAPGKEREFVSFISWISDITYYSDSVKGRFIISRDNAKNMVYLQMNSLKPEDTAVYYCAAHPPDPSRGGEWRLQTPSEYDYWGQGTQVTVSSAAAYPYDVPDYGSHHHHHH

SEQ ID NO: 595 - protein, 143 aa, Artificial Sequence
  Synthetic polymer
QVQLQESGGGLVQAGGSLRLSCAASGHTFSSYTMGWFRQAPGKEREFVAFIDWSGGGTYYADSVKGRFTISRDNAENTVYLQMNNLKPEDTAVYYCAAAQRLGSVTDYTKYDYWGQGTQVTVSSAAAYPYDVPDYGSHHHHHH

SEQ ID NO: 596 - protein, 151 aa, Artificial Sequence
  Synthetic polymer
QVQLQESGGGLVQAGGSLRLSCAASGRTFSTYPVGWFRQAPGKEREFVAVILWSGVSTYYADSVKGRFTISRDNAQNTVYLQMDSLKPEDTAVYYCAVPRSHFTTAQDMGQDMGAPSWYEYWGQGTQVTVSSAAAYPYDVPDYGSHHHHHH

SEQ ID NO: 597 - protein, 149 aa, Artificial Sequence
  Synthetic polymer
QVQLQESGGGLVQAGGSLRLSCAASGRTFSNYAMGWFRQAPGKEREFVAAIVWSGGSTYYADSVKGRFTISRDNAKNTVYLQMNSLKPEDTAVYYCAAVLIRYYSGGYQGLSDANEYDYWGQGTQVTVSSAAAYPYDVPDYGSHHHHHH

SEQ ID NO: 598 - protein, 144 aa, Artificial Sequence
  Synthetic polymer
QVQLQESGGGLVQAGASLRLSCSASGRTFSDYRMGWFRQAPGKEREWVAAISSSGYHTYYADSVKGRFTISRDNAKNTGYLQMSSLKPEDTAVYYCAVVKYLSGSYSYAGQYNFWGQGTQVTVSSAAAYPYDVPDYGSHHHHHH

SEQ ID NO: 599 - protein, 150 aa, Artificial Sequence
  Synthetic polymer
QVQLQESGGGLVQAGDSLKLSCAASGLTFSNYIMAWFRQAPGKEREGVSCISSPDGSTYYADSVKGRFTISSDNAKNTVYLQMNSLKPEDTAVYYCAADFNVWSPPICGSVGPPPGGMDYWGKGTQVTVSSAAAYPYDVPDYGSHHHHHH

SEQ ID NO: 600 - protein, 148 aa, Artificial Sequence
  Synthetic polymer
QVQLQESGGGLVQAGGSLRLSCAASGRTFSNSVMGWFRQPPGKEREFVAAVLWSGVSTAYADSVKGRFTISRDNAKNTVYLQMNNLKPDDTAVYYCAAHESTYYSGTYYLTDPRRYVYWGQGTQVTVSSAAAYPYDVPDYGSHHHHHH

SEQ ID NO: 601 - protein, 146 aa, Artificial Sequence
  Synthetic polymer
QVQLQESGGGLVQAGGSLRLSCVGDGRTFSSYIIGWFRQAPGNEREFVVAITWDGSATTYADSVKGRFTVSRDSAKNTAYLQMNSLKPEDTAVYYCAAVPARGLTMDLENSDIYDHWGRGTQVTVSSAAAYPYDVPDYGSHHHHHH

SEQ ID NO: 602 - protein, 149 aa, Artificial Sequence
  Synthetic polymer
QVQLQESGGGLVQAGGSLRLSCAASGRTFSSYVMGWFRQALGKEREFVAAIGWNGGITYYADSVKGRFAISRDNAKNTVYLQMNSLKPEDTAVYYCAAATLQVTGSYYLDLSTVDIYDNWGQGTQVTVSSAAAYPYDVPDYGSHHHHHH

SEQ ID NO: 603 - protein, 147 aa, Artificial Sequence
  Synthetic polymer
QVQLQESGGGLVQAGGSLRLSCAASGGTFSNYVMGWFRQAPGKEREFVGFITWSGASTYYADSVKGRFTISRDNAENTVYLQMNSLKPEDTAVYYCAATLFRSNGPKDLSSGYEYDYWGQGTQVTVSSAAAYPYDVPDYGSHHHHHH

SEQ ID NO: 604 - protein, 140 aa, Artificial Sequence
  Synthetic polymer
  misc_feature (112)..(112): Xaa can be any naturally occurring amino acid
QVQLQESGGGLVQAGDSLRLTCTASGRTFSNYGIGWFRQAPGKEREFVAGINWSGESADYADSVKGRFTISRDNAKNTVYLQMNSLKPEDTAVYYCAAGESGVWVGGLDYWXQGTQVTVSSAAAYPYDVPDYGSHHHHHH

SEQ ID NO: 605 - protein, 149 aa, Artificial Sequence
  Synthetic polymer
QVQLQESGGGLVQAGGSLRLSCAASGFTFDDYAIAWFRQAPGKEREGVSCIERSDGSTYYADSVKGRFTISSDNAKNTVYLQMNSLKPEDTAVYYCAVGSANSGEFRFGWVLKPDLYNYWGQGTQVTVSSAAAYPYDVPDYGSHHHHHH

SEQ ID NO: 606 - protein, 150 aa, Artificial Sequence
  Synthetic polymer
QVQLQESGGGLVQAGGSLRLSCTASGRTFSSYTVAWFRQSPGKEREGISCISNTDSSTYYADSVKGRFTISSDNAKSTVHLQMSSLKPEDTAVYYCAADGNVWSPPICGSAGPPPGGMDYWGKGTQVTVSSAAAYPYDVPDYGSHHHHHH

SEQ ID NO: 607 - protein, 150 aa, Artificial Sequence
  Synthetic polymer
QVQLQESGGGLVQPGGSLRLSCATFGFPFDDYAIAWFRQAPGKEREGVSCISNTDSSTYYADSVKGRFTISSDNAKNTVHLQMSSLKPEDTAVYYCAADGNVWSPPICGSAGPPPGGMDYWGKGTQVTVSSAAAYPYDVPDYGSHHHHHH

SEQ ID NO: 608 - protein, 147 aa, Artificial Sequence
  Synthetic polymer
QVQLQESGGGLVQAGGSLRLSCAASGRTFSSYVMGWFRQAPGKEREFVAQISWSAGSIYYADSVKGRFTISNDNAKRTVYLQMNSLKPEDTAVYYCAERGYAYCSDDGCQRTQDYDYWGQGTQVTVSSAAAYPYDVPDYGSHHHHHH

SEQ ID NO: 609 - protein, 148 aa, Artificial Sequence
  Synthetic polymer
QVQLQESGGGLVQAGGSLRLSCAASGRTLSSNPMAWFRQAAGKEREFVAGMSWNPGPAVYADSVKGRFTISRDSAENTVYLQMNSLKPEDTAVYYCAGAARAWWSGSYDYTRMNNYDYWGPGTQVTVSSAAAYPYDVPDYGSHHHHHH

SEQ ID NO: 610 - protein, 150 aa, Artificial Sequence
  Synthetic polymer
QVQLQESGGGLVQAGGSLRLSCAVSGFTFDNYAIGWFRQAPGKEREGVSCISRSDGSTYYADSVRGRFTISSDNAKNTVYLQMNSLKPEDTAVYYCAAETSADSGEFRFGWVLKPSLYDYWGQGTQVTVSSAAAYPYDVPDYGSHHHHHH

SEQ ID NO: 611 - protein, 148 aa, Artificial Sequence
  Synthetic polymer
QVQLQESGGGLVQAGGSLRLSCAASGRAFSSYFMGWFRQTPGKEREFVANIGWTGDMTYYADSVKGRFTISRDNAKNTVYLQMNSLKPEDTAVYYCAAAGSAYSGSYWNITMAANYDYWGQGTQVTVSSAAAYPYDVPDYGSHHHHHH

SEQ ID NO: 612 - protein, 145 aa, Artificial Sequence
  Synthetic polymer
QVQLQESGGGLVQAGGSLRLSCAASTPTFSSYNMGWFRQAPGKEREFVAAIIWSGSMTYYADSMKGRFTVSIDNAKNTVYLQMNSLKPEDTAVYYCAAQRIFGAQPMDLSGDYEYWGQGTQVTVSSAAAYPYDVPDYGSHHHHHH

SEQ ID NO: 613 - protein, 150 aa, Artificial Sequence
  Synthetic polymer
QVQLQESGGGLVQAGGSLRLSCATFGFTFDDYAIAWFRQAPGKEREGISCISNTDSSTYYADSVKGRFTISSDSAKNTVHLQMSSLKPEDTAVYYCAADGNVWSPPICGSAGPPPGGMDYWGKGTQVTVSSAAAYPYDVPDYGSHHHHHH

SEQ ID NO: 614 - protein, 145 aa, Artificial Sequence
  Synthetic polymer
QVQLQESGGGLVQAGGSLRLSCKASGGTFSGYIMGWFRQAPGKEREFVAANTWSGGPTYYSDSVKGRFTISRDNAKNTVYLQMNTLKPEDTAVYQCAARDYRGIKDLDLKGDYDYWGQGTQVTVSSAAAYPYDVPDYGSHHHHHH

SEQ ID NO: 615 - protein, 151 aa, Artificial Sequence
  Synthetic polymer
QVQLQESGGGLVQAGDSLKLSCATSGRSFSSYTIAWFRQAPGKEREGISCISSDGSTGYADSVRGRFTISSDNAKNTVYLQMNSLKPEDTAVYYCAADFNVWSPPICGSIWYGPPPRGMDYWGKGTQVTVSSAAAYPYDVPDYGSHHHHHH

SEQ ID NO: 616 - protein, 152 aa, Artificial Sequence
  Synthetic polymer
QVQLQESGGGLVQAGGYLRLSCAASGFSSDDYTIGWFRQAPGKEREGISCYSSSDGSTGFADSVKGRFTISSDNAKNTVYLQMNNLRPEDTAVYYCAADSNVWSPPICGSRWYGPPPGGMAYWGKGTQVTVSSAAAYPYDVPDYGSHHHHHH

SEQ ID NO: 617 - protein, 151 aa, Artificial Sequence
  Synthetic polymer
QVQLQESGGGLAQVGGSLRLSCTASGFTFDDYTIGWFRQAPGKEREGISCISSDGSTGYADSVKGRFTISSDNAKNTVYLQMNSLKPEDTAVYYCAADFNVWSPPICGSNWYGPPPGGMDYWGKGTQVTVSSAAAYPYDVPDYGSHHHHHH

SEQ ID NO: 618 - protein, 152 aa, Artificial Sequence
  Synthetic polymer
QVQLQESGGGLVQAGGSLRLSCAASGFSSDDYTIGWFRQAPGKEREGIGCIKSSDGTTGYADSVKGRFTISSDNAKNTVYLQMNSLKPEDTAVYYCAADFNVWSPPICGSIWYGPPPGGMDYWGKGTQVTVSSAAAYPYDVPDYGSHHHHHH

SEQ ID NO: 619 - protein, 150 aa, Artificial Sequence
  Synthetic polymer
QVQLQESGGGLAQAGGSLRLSCAASGFTFDQYTIAWFRQAPGKEREGVSCISNTDSSTYYADSVKGRFTISSDNAKNTVYLQMSSLKPEDTAVYYCAADGNVWSPPICGSAGPPPGGMDYWGKGTQVTVSSAAAYPYDVPDYGSHHHHHH

SEQ ID NO: 620 - protein, 144 aa, Artificial Sequence
  Synthetic polymer
QVQLQESGGGLVQAGGSLRLSCAASGRTFSSYAMAWFRQAPGKEREFVAAIAWSAGSTYYADSVKGRFAISRDNAENTVYLQMNSLKPEDTAVYYCAARIITVATMRLDSDYDYWGQGTQVTVSSAAAYPYDVPDYGSHHHHHH

SEQ ID NO: 621 - protein, 150 aa, Artificial Sequence
  Synthetic polymer
QVQLQESGGGLVQAGGSLRLSCAASGFAFDGYAIGWFRQAPGKEREGVSCISSKEGSTYYADSVKGRFTISSDNAKNTVYLQMSSLKPEDTAVYYCAADGNVWSPPICGSAGPPPGGMDYWGKGTQVTVSSAAAYPYDVPDYGSHHHHHH

SEQ ID NO: 622 - protein, 152 aa, Artificial Sequence
  Synthetic polymer
QVQLQESGGGLVQAGGSLRLSCAASGFSSDDYTIAWFRRAPGKEREGISCISSSDGSTGYADSVKGRFTITSDSAKNTVYLQMNSLKPEDTAVYYCAADSNVWSPPICGRTWYGPPPGGMDYWGKGTQVTVSSAAAYPYDVPDYGSHHHHHH

SEQ ID NO: 623 - protein, 152 aa, Artificial Sequence
  Synthetic polymer
QVQLQESGGGLVQPGGSLRLSCAASGFSSDDYTIGWFRQAPGKEREGISCYSSRDGTTGYADSVKGRFTISSDNAKNTVYLQMNSLKPEDTAVYYCAADFNVWSPPICGSIWYGPPPGGMAYWGQGTQVTVSSAAAYPYDVPDYGSHHHHHH

SEQ ID NO: 624 - protein, 151 aa, Artificial Sequence
  Synthetic polymer
QVQLQESGGGLVQAGGSLRLSCAASGFTFDDYTIGWFRQAPGKEREGISCISSDGSTGYADSVKGRFTISSDNAKNTVYLQMNSLKPEDTAVYYCAADFNVWSPPICGSNWYGPPPGGMDYWGKGTQVTVSSAAAYPYDVPDYGSHHHHHH

SEQ ID NO: 625 - protein, 152 aa, Artificial Sequence
  Synthetic polymer
QVQLQESGGGLVQAGGSLRLSCAASGFSSDDYTIGWFRQAPGKEREGISCYSSSDGSTGYADSVKGRFTISSDNAKNTVYLQMNSLKPEDTAVYYCAADFNVWSPPICGSSWYGPPPGGMDYWGKGTQVTVSSAAAYPYDVPDYGSHHHHHH

SEQ ID NO: 626 - protein, 152 aa, Artificial Sequence
  Synthetic polymer
QVQLQESGGGLVQAGGSLRLSCAASGFSSDDYTIGWFRQAPGKEREGISCFSSSDGSTGFADSVKGRFTISSDNATNTVYLEMNSLKPEDTAVYYCAADFNVWSPPICGSRWYGPPPGGMEYWGKGTQVTVSSAAAYPYDVPDYGSHHHHHH

SEQ ID NO: 627 - protein, 150 aa, Artificial Sequence
  Synthetic polymer
QVQLQESGGGLVQAGGSLRLSCATFGFSFDDYAIAWFRQAPGKEREGISCISNTDSSTFYADSVKGRFTISSDNAKNTVHLQMSSLKPEDTAVYYCAADGNVWSPPICGSAGPPPGGMDYWGKGTQVTVSSAAAYPYDVPDYGSHHHHHH

SEQ ID NO: 628 - protein, 152 aa, Artificial Sequence
  Synthetic polymer
QVQLQESGGGLVQAGGSLRLSCAASGFSSDDYTIGWFRQAPGKEREGISCYSSSDGSTGFADSVKGRFTISSDNAKNTVYLQMNSLRPEDTAVYYCAADFNVWSPPICGSRWYGPPPGGMAYWGKGTQVTVSSAAAYPYDVPDYGSHHHHHH

SEQ ID NO: 629 - protein, 151 aa, Artificial Sequence
  Synthetic polymer
QVQLQESGGGLVQVGGSLRLSCTISGFTGNDLAIGWFRQAPGKDQREGISCISNTDSSTYYADSVKGRFTISSDNAKNTVHLQMSSLKPEDTAVYYCAADGNVWSPPICGSAGPPPGGMDYWGKGTQVTVSSAAAYPYDVPDYGSHHHHHH

SEQ ID NO: 630 - protein, 152 aa, Artificial Sequence
  Synthetic polymer
QVQLQESGGGLVQAGGSLRLSCAASGFSSDDYTIAWFRRAPGKEREGISCISSSDGSTGYADSVKGRFTISSDNAKNTVYLQMTSLKPEDTAVYYCAADSNVWSPPICGKTWYGPPPGGMDYWGKGTQVTVSSAAAYPYDVPDYGSHHHHHH

SEQ ID NO: 631 - protein, 140 aa, Artificial Sequence
  Synthetic polymer
QVQLQESGGGLVQAGDSLRLSCAGSEGTLSSYGIGWFRQAPGKEREFVGGINWSGDSTDYADSVKGRFTISRDSAKNTVYLQMNSLKPEDTAVYYCAAGESGVWVGGLDYWGQGTQVTVSSAAAYPYDVPDYGSHHHHHH

SEQ ID NO: 632 - protein, 152 aa, Artificial Sequence
  Synthetic polymer
QVQLQESGGGLVQAGGSLRLSCAASGFSSDDYTIAWFRRAPGKEREGISCFSSSDGSAGYADSVKGRFTVSSDNAKNTVYLQMNSLKPEDTAVYYCAADSNVWSPPICGSTWYGPPPGGMAYWGKGTQVTVSSAAAYPYDVPDYGSHHHHHH

SEQ ID NO: 633 - protein, 150 aa, Artificial Sequence
  Synthetic polymer
QVQLQESGGGLVQAGGSLRLSCATSGFTFDDYAIAWFRQAPGKEREGVSCISNTDSSTYYADSVKGRFTISSDNAKNTVYLQMSSLKPEDTAVYYCAADGNVWSPPICGSAGPPPGGMDYWGKGTQVTVSSAAAYPYDVPDYGSHHHHHH

SEQ ID NO: 634 - protein, 152 aa, Artificial Sequence
  Synthetic polymer
QVQLQESGGGLVQAGGSLRLSCEVSGLSSDDYTIGWFRQAPGKEREGFSCFSTRDGNAGYADSVKGRFTISSDNAKNTVYLQMNNLKPEDTAVYYCAADFNVWSPPICGSRWYGPPPGGMDYWGKGTQVTVSSAAAYPYDVPDYGSHHHHHH

SEQ ID NO: 635 - protein, 152 aa, Artificial Sequence
  Synthetic polymer
QVQLQESGGGLVQAGGSLRLSCEVSGLSSDDYTIGWFRQAPGKKREGFSCFSSRDGSTGYADSVKGRFTISSDNAKNTVYLQMNSLKPEDTAVYYCAADFNVWSPPICGSRWYGPPPGGMDYWGKGTQVTVSSAAAYPYDVPDYGSHHHHHH

SEQ ID NO: 636 - protein, 152 aa, Artificial Sequence
  Synthetic polymer
QVQLQESGGGLVQAGGSLRLSCAASGFSSDDYTIGWFRQAPGKEREGFSCFSSRDGSTGYADSVKGRFTISSDNAKNTVYLQMNSLKPEDTAVYYCAADFNVWSPPICGSRWYGPPPGGMDYWGKGTQVTVSSAAAYPYDVPDYGSHHHHHH

SEQ ID NO: 637 - protein, 151 aa, Artificial Sequence
  Synthetic polymer
QVQLQESGGGLVQAGGSLRLSCAASGFSFDDYTIGWFRQVPGKEREGISCISSDGSTGYADSVKGRFTISSDNAKNTVYLQINSLKPEDTAVYYCAADFNVWSPPICGSIWYGPPPGGMDYWGKGTQVTVSSAAAYPYDVPDYGSHHHHHH

SEQ ID NO: 638 - protein, 150 aa, Artificial Sequence
  Synthetic polymer
QVQLQESGGGLVQAGGSLRLSCATFGFTFDDYAIAWFRQAPGKEREGISCISNTDSSTYYADSVKGRFTISSDNAKNTVHLQMSSLKPEDTAVYYCAADGNVWSPPICGSAGPPPGGMDYWGKGTQVTVSSAAAYPYDVPDYGSHHHHHH

SEQ ID NO: 639 - protein, 150 aa, Artificial Sequence
  Synthetic polymer
  misc_feature (19)..(19): Xaa can be any naturally occurring amino acid
QVQLQESGGGLVQAGGSLXLSCAASGFTFDDYAIGWFRQAPGKEREGVSCISSPDGSTYYADSVKGRFTISSDNAKNTVYLQMNSLKPEDTAVYYCAADFNVWSPPICGSVGPPPGGMDYWGKGTQVTVSSAAAYPYDVPDYGSHHHHHH

SEQ ID NO: 640 - protein, 152 aa, Artificial Sequence
  Synthetic polymer
QVQLQESGGGLVQAGASLRLSCKASGFTFGDYTIGWFRQAPGKEREGISCYSSSDGNTGYADSVKGRFTISSDNAKNTVYLQMNSLRPEDTAVYYCAADFNVWSPPICGSSWYGPPPGGMAYWGKGTQVTVSSAAAYPYDVPDYGSHHHHHH

SEQ ID NO: 641 - protein, 140 aa, Artificial Sequence
  Synthetic polymer
QVQLQESGGGLVQAGDSLRLSCAGSEGTFSSYGIGWFRQAPGKEREFVGGINWSGDSTDYADSVKGRFTISRDNAKNTVYLQMNSLKPEDTAVYYCAAGESGVWVGGLDYWGQGTQVTVSSAAAYPYDVPDYGSHHHHHH

SEQ ID NO: 642 - protein, 152 aa, Artificial Sequence
  Synthetic polymer
QVQLQESGGGLVQAGGSLRLSCAASGFSSDDYTIGWFRQAPGKEREGISCFSSSDGSTGFADSVKGRFTISSDNATNTVYLQMNSLKPEDTAVYYCAADFNVWSPPICGSSWYGPPPGGMEYWGKGTQVTVSSAAAYPYDVPDYGSHHHHHH

SEQ ID NO: 643 - protein, 150 aa, Artificial Sequence
  Synthetic polymer
QVQLQESGGGLVQAGDSLRLSCTASGVSIGDYNIGWFRQAPGKEREGVSCISSGDGTTYYTDSVKGRFTISTDNAKNTVYLQMNSLKPEDTAVYYCAADGNVWSPPICGSAGPPPGGMDYWGKGTQVTVSSAAAYPYDVPDYGSHHHHHH

SEQ ID NO: 644 - protein, 152 aa, Artificial Sequence
  Synthetic polymer
QVQLQESGGGLVQAGGSLRLSCAASGFTFDDYTIAWFRQAPGGKEREGISCISSDGSTGYADSVKGRFTISSDNAKNMVYLQMNSLKPEDTALYYCAADFNVWSPPICSSNWYGPPPRGMDYWGKGTQVTVSSAAAYPYDVPDYGSHHHHHH

SEQ ID NO: 645 - protein, 151 aa, Artificial Sequence
  Synthetic polymer
QVQLQESGGGLVQAGGSLRLSCAASGFTFDDYTIAWFRQAPGKEREGISCISSDGSTGYADSVRGRFTISSDNAKNTVYLQMNSLKPEDTAVYYCAADFNVWSPPICGSIWYGPPPRGMDYWGKGTQVTVSSAAAYPYDVPDYGSHHHHHH

SEQ ID NO: 646 - protein, 118 aa, Artificial Sequence
  Synthetic polymer
EVQLVESGGGLVQPGGSLRLSCAASGFNIKDTYIHWVRQAPGKGLEWVARIDPANDNTLYASKFQGRATISADTSKNTAYLQMNSLRAEDTAVYYCGRGYGYYVFDHWGQGTLVTVSS

SEQ ID NO: 647 - protein, 118 aa, Artificial Sequence
  Synthetic polymer
QVQLVQSGAEVKKPGATVKISCKVSGFNIKDTYIHWVQQAPGKGLEWMGRIDPANDNTLYASKFQGRVTITADTSTDTAYMELSSLRSEDTAVYYCARGYGYYVFDHWGQGTLVTVSS

SEQ ID NO: 648 - protein, 117 aa, Artificial Sequence
  Synthetic polymer
DVQITQSPSSLSASVGDRVTITCRTSRSISQYLAWYQQKPGKVPKLLIYSGSTLQSGVPSRFSGSGSGTDFTLTISSLQPEDVATYYCQQHNENPLTFGGGTKVEIKGFSMDYYAIA

SEQ ID NO: 649 - protein, 10 aa, Artificial Sequence
  Synthetic polymer
GFSMDYYAIA

SEQ ID NO: 650 - protein, 10 aa, Artificial Sequence
  Synthetic polymer
GFSMDYYAIA

SEQ ID NO: 651 - protein, 10 aa, Artificial Sequence
  Synthetic polymer
GFSVDYYAIA

SEQ ID NO: 652 - protein, 10 aa, Artificial Sequence
  Synthetic polymer
GFSMDYYAIA

SEQ ID NO: 653 - protein, 10 aa, Artificial Sequence
  Synthetic polymer
GGFNRVSYMG

SEQ ID NO: 654 - protein, 10 aa, Artificial Sequence
  Synthetic polymer
GGFNRVSYMG

SEQ ID NO: 655 - protein, 10 aa, Artificial Sequence
  Synthetic polymer
GIIKSINFMG

SEQ ID NO: 656 - protein, 10 aa, Artificial Sequence
  Synthetic polymer
GFILDYYGIG

SEQ ID NO: 657 - protein, 10 aa, Artificial Sequence
  Synthetic polymer
GLSLDYDGVG

SEQ ID NO: 658 - protein, 10 aa, Artificial Sequence
  Synthetic polymer
GFILDYYGIG

SEQ ID NO: 659 - protein, 10 aa, Artificial Sequence
  Synthetic polymer
GRTFSSLGMG

SEQ ID NO: 660 - protein, 10 aa, Artificial Sequence
  Synthetic polymer
GRTFSSLGMG

SEQ ID NO: 661 - protein, 10 aa, Artificial Sequence
  Synthetic polymer
GFAFGSYDMG

SEQ ID NO: 662 - protein, 10 aa, Artificial Sequence
  Synthetic polymer
GFSFGNNDMS

SEQ ID NO: 663 - protein, 11 aa, Artificial Sequence
  Synthetic polymer
CITGSDFMVDT

SEQ ID NO: 664 - protein, 11 aa, Artificial Sequence
  Synthetic polymer
CITGSDFMVDT

SEQ ID NO: 665 - protein, 11 aa, Artificial Sequence
  Synthetic polymer
CITGSDFMVDT

SEQ ID NO: 666 - protein, 11 aa, Artificial Sequence
  Synthetic polymer
CITGSDFMVDT

SEQ ID NO: 667 - protein, 8 aa, Artificial Sequence
  Synthetic polymer
SVTSGGEI

SEQ ID NO: 668 - protein, 8 aa, Artificial Sequence
  Synthetic polymer
SVTSGGEI

SEQ ID NO: 669 - protein, 8 aa, Artificial Sequence
  Synthetic polymer
STTSDGRT

SEQ ID NO: 670 - protein, 9 aa, Artificial Sequence
  Synthetic polymer
CISSSDGST

SEQ ID NO: 671 - protein, 9 aa, Artificial Sequence
  Synthetic polymer
CISSSDGST

SEQ ID NO: 672 - protein, 9 aa, Artificial Sequence
  Synthetic polymer
CISSSDGST

SEQ ID NO: 673 - protein, 9 aa, Artificial Sequence
  Synthetic polymer
AIAWNGAST

SEQ ID NO: 674 - protein, 9 aa, Artificial Sequence
  Synthetic polymer
AIAWNGAST

SEQ ID NO: 675 - protein, 9 aa, Artificial Sequence
  Synthetic polymer
GINSGGRIT

SEQ ID NO: 676 - protein, 9 aa, Artificial Sequence
  Synthetic polymer
AINSGGGST

SEQ ID NO: 677 - protein, 19 aa, Artificial Sequence
  Synthetic polymer
AVRSTANTLCPSHYSVMDY

SEQ ID NO: 678 - protein, 19 aa, Artificial Sequence
  Synthetic polymer
AVRSTANTLCPSHYSIMDY

SEQ ID NO: 679 - protein, 19 aa, Artificial Sequence
  Synthetic polymer
AVRSTANTLCPSHYSVMDY

SEQ ID NO: 680 - protein, 14 aa, Artificial Sequence
  Synthetic polymer
NADIWVSDARMYNY

SEQ ID NO: 681 - protein, 14 aa, Artificial Sequence
  Synthetic polymer
NADIWVSDARMYNY

SEQ ID NO: 682 - protein, 14 aa, Artificial Sequence
  Synthetic polymer
NADIWLPSDRMYNY

SEQ ID NO: 683 - protein, 13 aa, Artificial Sequence
  Synthetic polymer
ATATLCDGGIWGY

SEQ ID NO: 684 - protein, 13 aa, Artificial Sequence
  Synthetic polymer
ATATLCDGGIWGY

SEQ ID NO: 685 - protein, 13 aa, Artificial Sequence
  Synthetic polymer
ATATLCDGGIWGY

SEQ ID NO: 686 - protein, 17 aa, Artificial Sequence
  Synthetic polymer
AASGLGSVVVTANEYDY

SEQ ID NO: 687 - protein, 17 aa, Artificial Sequence
  Synthetic polymer
AASGLGSVVVTANEYDY

SEQ ID NO: 688 - protein, 15 aa, Artificial Sequence
  Synthetic polymer
AQGDRSSWHYYGMDY

SEQ ID NO: 689 - protein, 13 aa, Artificial Sequence
  Synthetic polymer
ATKSDPMTNEYDL

SEQ ID NO: 690 - protein, 147 aa, Artificial Sequence
  Synthetic polymer
QVQLQESGGGLVQPGGSLRLSCAASGFSMDYYAIAWFRQAPGKEREEISCITGSDFMVDTYYVASVKGRFTISRDNAENTAYLQMNNLKPEDTGVYFCAVRSTANTLCPSHYSVMDYWGKGTQVTVSSAAAYPYDVPDYGSHHHHHH

SEQ ID NO: 691 - protein, 147 aa, Artificial Sequence
  Synthetic polymer
QVQLQESGGGLVQAGGSLRLSCAASGFSMDYYAIAWFRQAPGKEREEISCITGSDFMVDTYYVASVKGRFTISRDNAENTAYLQMNNLKPEDTGVYFCAVRSTANTLCPSHYSVMDYWGKGTQVTVSSAAAYPYDVPDYGSHHHHHH

SEQ ID NO: 692 - protein, 146 aa, Artificial Sequence
  Synthetic polymer
QVQLQESGGGLVQPGGSLRLSCSASGFSVDYYAIAWFRQAPGKEREEISCITGSDFMVDTYYVASVKGRFTISRDNAKNTAYLQMNSLKPEDTGVYFCAVRSTANTLCPSHYSIMDYWGKGTQVTVSSAAAYPYDVPDYGSHHHHH

SEQ ID NO: 693 - protein, 147 aa, Artificial Sequence
  Synthetic polymer
QVQLQESGGGLVQPGGSLRLSCSASGFSMDYYAIAWFRQAPGKEREEISCITGSDFMVDTYYVASVKGRFTISRDNAKNTAHLQMNSLKPEDTGVYFCAVRSTANTLCPSHYSVMDYWGKGTQVTVSSAAAYPYDVPDYGSHHHHHH

SEQ ID NO: 694 - protein, 139 aa, Artificial Sequence
  Synthetic polymer
QVQLQESGGGLVQAGGSLRLSCAASGGFNRVSYMGWYRQAPGTKRELVASVTSGGEITIADSVKGRFTVSRDNSKNTLYLQMNGLKPEDGATYWCNADIWVSDARMYNYWGQGTQVTVSSAAAYPYDVPDYGSHHHHHH

SEQ ID NO: 695 - protein, 139 aa, Artificial Sequence
  Synthetic polymer
QVQLQESGGGLVQTGESLRLSCAASGGFNRVSYMGWYRQAPGSKRELVASVTSGGEITVADSVKGRFTVSRDNNKNTLYLQMNGLKPEDGATYWCNADIWVSDARMYNYWGQGTQVTVSSAAAYPYDVPDYGSHHHHHH

SEQ ID NO: 696 - protein, 139 aa, Artificial Sequence
  Synthetic polymer
QVQLQESGGGLVQTGESLRLSCAASGIIKSINFMGWYRQPPGTKRELVASTTSDGRTTVADSVKGRFTISRDNAKNTIYLEMSSLKPEDTATYWCNADIWLPSDRMYNYWGQGTQVTVSSAAAYPYDVPDYGSHHHHHH

SEQ ID NO: 697 - protein, 139 aa, Artificial Sequence
  Synthetic polymer
QVQLQESGGGLVQAGGSLRLSCAVSGFILDYYGIGWFRQAPGKEREAVSCISSSDGSTYYADSVKGRFTISRDNALNTLYLQMNSLKPEDTAVYHCATATLCDGGIWGYWGQGTQVTVSSAAAYPYDVPDYGSHHHHHH

SEQ ID NO: 698 - protein, 139 aa, Artificial Sequence
  Synthetic polymer
QVQLQESGGGLAQAGGSLRLSCEGSGLSLDYDGVGWFRQAPGKEREAVSCISSSDGSTYYADSVKGRFTISRGNALNTLYLQMNSLKPEDTAVYYCATATLCDGGIWGYWGQGTQVTVSSAAAYPYDVPDYGSHHHHHH

SEQ ID NO: 699 - protein, 139 aa, Artificial Sequence
  Synthetic polymer
QVQLQESGGGSVQPGGSLRLSCAVSGFILDYYGIGWFRQAPGKEREAVSCISSSDGSTYYADSVKGRFTISRDNALNTLYLQMNSLKPEDTAVYYCATATLCDGGIWGYWGQGTQVTVSSAAAYPYDVPDYGSHHHHHH

SEQ ID NO: 700 - protein, 143 aa, Artificial Sequence
  Synthetic polymer
QVQLQESGGGSVQAGDSLRLSCTASGRTFSSLGMGWFRQAPGKEREFVSAIAWNGASTYYTESVKGRFTISRDDAKNTVYLQMNSLKPTDTAVYFCAASGLGSVVVTANEYDYWGQGTQVTVSSAAAYPYDVPDYGSHHHHHH

SEQ ID NO: 701 - protein, 143 aa, Artificial Sequence
  Synthetic polymer
QVQLQESGGGSVQPGKSLRLSCAASGRTFSSLGMGWFRQAPGKEREFVSAIAWNGASTYYTESVKGRFTISRDDAKNTVYLQMNSLKPTDTAVYFCAASGLGSVVVTANEYDYWGQGTQVTVSSAAAYPYDVPDYGSHHHHHH

SEQ ID NO: 702 - protein, 141 aa, Artificial Sequence
  Synthetic polymer
QVQLQESGGGLVQPGGSLRLSCTTSGFAFGSYDMGWVRQAPGKGPEWVSGINSGGRITDYADSVTGRFTISRDNAKNTLYLQMNSLKPEDTAVYYCAQGDRSSWHYYGMDYWGKGTQVTVSSAAAYPYDVPDYGSHHHHHH

SEQ ID NO: 703 - protein, 139 aa, Artificial Sequence
  Synthetic polymer
  misc_feature (112)..(112): Xaa can be any naturally occurring amino acid
QVQLQESGGGLVQPGGSLRLSCAASGFSFGNNDMSWVRQAPGKGPEWVSAINSGGGSTYYADSVKGRFTISRDNAKNTLYLQMNSLKPEDTAVYYCATKSDPMTNEYDLWGXGTQVTVSSAAAYPYDVPDYGSHHHHHH

SEQ ID NO: 704 - protein, 447 aa, Artificial Sequence
  Synthetic polymer
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 705 - protein, 218 aa, Artificial Sequence
  Synthetic polymer
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 706 - protein, 440 aa, Artificial Sequence
  Synthetic polymer
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 707 - protein, 214 aa, Artificial Sequence
  Synthetic polymer
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 708 - protein, 106 aa, Artificial Sequence
  Synthetic polymer
EIVLTQSPSSLSASVGDRVTITCSARSSVSYMHWYQQKPGKAPKLLIYRTSNLASGVPSRFSGSGSGTDFTLTINSLQPEDFATYYCQQRSSFPLTFGGGTKLEIK

SEQ ID NO: 709 - protein, 106 aa, Artificial Sequence
  Synthetic polymer
EIVLTQSPSSLSASVGDRVTITCSARSSVSYMHWFQQKPGKAPKLWIYRTSNLASGVPSRFSGSGSGTDYTLTINSLQPEDFATYYCQQRSSFPLTFGGGTKLEIK

SEQ ID NO: 710 - protein, 106 aa, Artificial Sequence
  Synthetic polymer
EIVLTQSPSSLSASVGDRVTITCSARSSVSYMHWFQQKPGKAPKLWIYRTSNLASGVPSRFSGSGSGTDYCLTINSLQPEDFATYYCQQRSSFPLTFGGGTKLEIK

SEQ ID NO: 711 - protein, 106 aa, Artificial Sequence
  Synthetic polymer
EIVLTQSPSSLSASVGDRVTITCSARSSVSYMHWFQQKPGKAPKLWIYRTSNLASGVPSRFSGSGSGTSYCLTINSLQPEDFATYYCQQRSSFPLTFGGGTKLEIK

SEQ ID NO: 712 - protein, 117 aa, Artificial Sequence
  Synthetic polymer
QVQLVQSGSELKKPGASVKISCKASGYSFSNYGMNWVRQAPGQGLQWMGWINTDSGESTYAEEFKGRFVFSLDTSVSTAYLQITSLTAEDTGMYFCAKVGYDALDYWGQGTLVTVSS

SEQ ID NO: 713 - protein, 117 aa, Artificial Sequence
  Synthetic polymer
QVQLVQSGSELKKPGASVKISCKASGYTFTNYGMNWVRQAPGQGLQWMGWINTDSGESTYAEEFKGRFVFSLDTSVSTAYLQITSLTAEDTGMYFCAKVGYDALDYWGQGTLVTVSS

SEQ ID NO: 714 - protein, 117 aa, Artificial Sequence
  Synthetic polymer
QVQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSS

SEQ ID NO: 715 - protein, 117 aa, Artificial Sequence
  Synthetic polymer
QIQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSS

SEQ ID NO: 716 - protein, 117 aa, Artificial Sequence
  Synthetic polymer
QIQLVQSGSELKKPGASVKISCKASGYTFTNYGMNWVKQAPGQGLKWMGWINTDSGESTYAEEFKGRFAFSLDTSVNTAYLQITSLNAEDTGMYFCVRVGYDALDYWGQGTLVTVSS

SEQ ID NO: 717 - protein, 254 aa, Artificial Sequence
  Synthetic polymer
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 718 - protein, 453 aa, Artificial Sequence
  Synthetic polymer
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 719 - protein, 29 aa, Artificial Sequence
  Synthetic polymer
SNTSESFKSNTSESFFRVTQLAPKAQIKE

SEQ ID NO: 720 - protein, 119 aa, Artificial Sequence
  Synthetic polymer
EVQLQQSGPVLVKPGASVKMSCKASGYTFTDYYMNWVKQSHGKSLEWIGNINPYNGGTTYNQKFKGKATLTVDKSSRTAYMEINSLTSEDSAVYYCARGRIYDGSLDYWGQGTALTVSS

SEQ ID NO: 721 - protein, 100 aa, Artificial Sequence
  Synthetic polymer
DIQMTQFPSSLCASQGGKVTVTCKASQDINNYMAWYQHKPGKGPRLLIHYTSTLLSGIPSRFSGSGSGRDYSFSISNLEPEDIATYYCLQYDNLWTFGGG

SEQ ID NO: 722 - protein, 6 aa, Artificial Sequence
  Synthetic polymer
TKLEIK

SEQ ID NO: 723 - protein, 116 aa, Artificial Sequence
  Synthetic polymer
QVQLQQSGAELAKPGASVRLSCKASGYTFTNYWMHWVKQRPGQGLEWIGHINPSSGFTTYNQNFKDKATLTADKSSNTAYMQLSSLTYEDSAVYFCAREDYDVDYWGQGTTLTVSS

SEQ ID NO: 724 - protein, 100 aa, Artificial Sequence
  Synthetic polymer
DIVMTQSQKFMSTSVGDRVSVTCKASQSVDTNVAWYQQKPGQSPKALIFSASYRYSGVPDRFTGSGSGTDFTLTINSVQSEDLAEYFCQQYNSYPYTFGS

SEQ ID NO: 725 - protein, 7 aa, Artificial Sequence
  Synthetic polymer
GTKLEIK

SEQ ID NO: 726 - protein, 122 aa, Artificial Sequence
  Synthetic polymer
EVQLVESGGGLVKPGGSLKLSCAASGFTFSDYGMHWVRQAPEKGLEWVAYISSGSYTIYYTDTVKGRFTISRDNAKNTLFLQMTSLRSEDTAMYYCARRGYGSFYEYYFDYWGQGTTLTVSS

SEQ ID NO: 727 - protein, 106 aa, Artificial Sequence
  Synthetic polymer
QIVLTQSPALMSASPGEKVTMTCSASSSVSYMYWYQQKPRSSPKPWIYLTSNLASGVPARFSGSGSGTSYSLTISSMEAEDAATYYCQQWSSNPFTFGSGTKLEIK

SEQ ID NO: 728 - protein, 119 aa, Artificial Sequence
  Synthetic polymer
EVQLVESGGGLVQAGKSLRLSCAASGSIFSIHAMGWFRQAPGKEREFVAAITWSGGITYYEDSVKGRFTISRDNAKNTVYLQMNSLKPEDTAIYYCAADRAESSWYDYWGQGTQVTVSS

SEQ ID NO: 729 - protein, 119 aa, Artificial Sequence
  Synthetic polymer
EVQLVESGGGLVQAGGSLRLSCAASGSIASIHAMGWFRQAPGKEREFVAVITWSGGITYYADSVKGRFTISRDNAKNTVYLQMNSLKPEDTAIYYCAGDKHQSSWYDYWGQGTQVTVSS

SEQ ID NO: 730 - protein, 119 aa, Artificial Sequence
  Synthetic polymer
EVQLVESGGGLVQAGGSLRLSCAASGSISSIHAMGWFRQAPGKEREFVAAITWSGGITYYADSLKGRFTISRDNAKNTGYLQMNSLKPEDTAIYYCAADRAQSSWYDYWGQGTQVTVSS

SEQ ID NO: 731 - protein, 119 aa, Artificial Sequence
  Synthetic polymer
EVQLVESGGGLVQAGGSLGLSCAASGSIFSINAMAWFRQAPGKEREFVALISWSGGSTYYEDSVKGRFTISRDNAKNTVYLQMNSLKPEDTAIYYCAADRVDSNWYDYWGQGTQVTVSS

SEQ ID NO: 732 - protein, 120 aa, Artificial Sequence
  Synthetic polymer
EVQLVESGGGLVQAGGSLRLSCAASGRAFSSGTMGWFRRAPGKEREFVASIPWSGGRIYYADSVKGRFTISRDNAQNTVYLQMNSLKPEDTAVYYCAVKERSTGWDFASWGQCTQVTVSS

SEQ ID NO: 733 - protein, 121 aa, Artificial Sequence
  Synthetic polymer
QVQLVQSGAELKQPGASVKMSCKASGYSFTSSWIHWVKQAPGQGLEWIGYIYPSTGFTEYNQKFKDRATLTADKSTSTAYMELSSLRSEDSAVYYCARWRDSSGYHAMDYWGQGTSVTVSS

SEQ ID NO: 734 - protein, 121 aa, Artificial Sequence
  Synthetic polymer
QVQLVQSGAEVKQPGASVKMSCKASGYSFTSSWIHWVKQAPGQGLEWIGYIYPSTGFTEYNQKFKDRATLTADKSTSTAYMELSSLRSEDTAVYYCARWRDSSGYHAMDYWGQGTSVTVSS

SEQ ID NO: 735 - protein, 121 aa, Artificial Sequence
  Synthetic polymer
QVQLVQSGHEVKQPGASVKMSCKASGYSFTSSWIHWVKQAPGQGLEWIGYIYPSTGFTEYNQKFKDRATLTADKSTSTAYMELSSLRSEDTAVYYCARWRDSSGYHAMDYWGQGTLVTVSS

SEQ ID NO: 736 - protein, 121 aa, Artificial Sequence
  Synthetic polymer
QVQLVQSGHEVKQPGASVKMSCKASGYSFTSSWIHWVRQAPGQGLEWIGYIYPSTGFTEYNQKFKDRATLTADKSTSTAYMELSSLRSEDTAVYYCARWRDSSGYHAMDYWGQGTLVTVSS

SEQ ID NO: 737 - protein, 121 aa, Artificial Sequence
  Synthetic polymer
QVQLVQSGHEVKQPGASVKVSCKASGYSFTSSWIHWVRQAPGQGLEWIGYIYPSTGFTEYNQKFKDRATITADKSTSTAYMELSSLRSEDTAVYYCARWRDSSGYHAMDYWGQGTLVTVSS

SEQ ID NO: 738 - protein, 111 aa, Artificial Sequence
  Synthetic polymer
DIVLTQSPASLTLSPGQRLTISCRASQSVSTSGYSYMHWYQQKPDQSPKLLIKFGSNLESGIPARFSGSGSGTDFTLTISSLEEEDFATYYCQHSWEIPYTFGQGTKLEIK

SEQ ID NO: 739 - protein, 111 aa, Artificial Sequence
  Synthetic polymer
DIVLTQSPATLSLSPGQRLTISCRASQSVSTSGYSYMHWYQQKPDQSPKLLIKFGSNLESGIPARFSGSGSGTDFTLTISSLEPEDFATYYCQHSWEIPYTFGQGTKLEIK

SEQ ID NO: 740 - protein, 111 aa, Artificial Sequence
  Synthetic polymer
EIVLTQSPATLSLSPGQRLTISCRASQSVSTSGYSYMHWYQQKPDQSPKLLIKFGSNLESGIPARFSGSGSGTDFTLTISSLEPEDFATYYCQHSWEIPYTFGQGTKLEIK

SEQ ID NO: 741 - protein, 111 aa, Artificial Sequence
  Synthetic polymer
DIVLTQSPATLSLSPGQRLTISCRASQSVSTSGYSYMHWYQQKPDQSPKLLIKFGSNLESGIPARFSGSGSGTDFTLTISSLEPEDFAVYYCQHSWEIPYTFGQGTKLEIK

SEQ ID NO: 742 - protein, 10 aa, Artificial Sequence
  Synthetic polymer
GFTLDYYAIG

SEQ ID NO: 743 - protein, 10 aa, Artificial Sequence
  Synthetic polymer
GTIFSINHMD

SEQ ID NO: 744 - protein, 10 aa, Artificial Sequence
  Synthetic polymer
GFTFDDYGMS

SEQ ID NO: 745 - protein, 10 aa, Artificial Sequence
  Synthetic polymer
GFTLDYYAIN

SEQ ID NO: 746 - protein, 10 aa, Artificial Sequence
  Synthetic polymer
GTIFSINRMD

SEQ ID NO: 747 - protein, 10 aa, Artificial Sequence
  Synthetic polymer
GFTFSSYGMS

SEQ ID NO: 748 - protein, 10 aa, Artificial Sequence
  Synthetic polymer
GKIFSGNDMG

SEQ ID NO: 749 - protein, 10 aa, Artificial Sequence
  Synthetic polymer
GTIFSINRMD

SEQ ID NO: 750 - protein, 10 aa, Artificial Sequence
  Synthetic polymer
GFTFSSYGMS

SEQ ID NO: 751 - protein, 10 aa, Artificial Sequence
  Synthetic polymer
GFTFNDYAMS

SEQ ID NO: 752 - protein, 10 aa, Artificial Sequence
  Synthetic polymer
GFNLDPYAIA

SEQ ID NO: 753 - protein, 10 aa, Artificial Sequence
  Synthetic polymer
GFTFTAYAMS

SEQ ID NO: 754 - protein, 10 aa, Artificial Sequence
  Synthetic polymer
GFTFDYYAIG

SEQ ID NO: 755 - protein, 10 aa, Artificial Sequence
  Synthetic polymer
GFNLDPYAIA

SEQ ID NO: 756 - protein, 10 aa, Artificial Sequence
  Synthetic polymer
GTIFSINRMD

SEQ ID NO: 757 - protein, 10 aa, Artificial Sequence
  Synthetic polymer
GTIFSINRMD

SEQ ID NO: 758 - protein, 10 aa, Artificial Sequence
  Synthetic polymer
GFTFSSYGMS

SEQ ID NO: 759 - protein, 10 aa, Artificial Sequence
  Synthetic polymer
GFNLDPYAIG

SEQ ID NO: 760 - protein, 10 aa, Artificial Sequence
  Synthetic polymer
GFNLDPYAIA

SEQ ID NO: 761 - protein, 10 aa, Artificial Sequence
  Synthetic polymer
ESIFSIEAMG

SEQ ID NO: 762 - protein, 10 aa, Artificial Sequence
  Synthetic polymer
GKIFSGNDMG

SEQ ID NO: 763 - protein, 10 aa, Artificial Sequence
  Synthetic polymer
GFTLDYYAIG

SEQ ID NO: 764 - protein, 10 aa, Artificial Sequence
  Synthetic polymer
GFTFSSYGMS

SEQ ID NO: 765 - protein, 10 aa, Artificial Sequence
  Synthetic polymer
GTIFSINRMD

SEQ ID NO: 766 - protein, 10 aa, Artificial Sequence
  Synthetic polymer
GFTFSSYGMS

SEQ ID NO: 767 - protein, 10 aa, Artificial Sequence
  Synthetic polymer
GFNLDPYAIA

SEQ ID NO: 768 - protein, 10 aa, Artificial Sequence
  Synthetic polymer
GRTFSISAMG

SEQ ID NO: 769 - protein, 10 aa, Artificial Sequence
  Synthetic polymer
GFTLDYYAIN

SEQ ID NO: 770 - protein, 10 aa, Artificial Sequence
  Synthetic polymer
GFTFSSYGMS

SEQ ID NO: 771 - protein, 10 aa, Artificial Sequence
  Synthetic polymer
GFTFNDYAMS

SEQ ID NO: 772 - protein, 10 aa, Artificial Sequence
  Synthetic polymer
GFTLDYYAIG

SEQ ID NO: 773 - protein, 9 aa, Artificial Sequence
  Synthetic polymer
ISSSDGSTY

SEQ ID NO: 774 - protein, 8 aa, Artificial Sequence
  Synthetic polymer
ITSDGFPT

SEQ ID NO: 775 - protein, 9 aa, Artificial Sequence
  Synthetic polymer
IRWNGGSTN

SEQ ID NO: 776 - protein, 9 aa, Artificial Sequence
  Synthetic polymer
ISSSDGSTY

SEQ ID NO: 777 - protein, 8 aa, Artificial Sequence
  Synthetic polymer
ITSDGTPT

SEQ ID NO: 778 - protein, 9 aa, Artificial Sequence
  Synthetic polymer
IDSGGGSTS

SEQ ID NO: 779 - protein, 8 aa, Artificial Sequence
  Synthetic polymer
ITSGGITD

SEQ ID NO: 780 - protein, 8 aa, Artificial Sequence
  Synthetic polymer
ITSDGTPT

SEQ ID NO: 781 - protein, 9 aa, Artificial Sequence
  Synthetic polymer
IDSGGGSTS

SEQ ID NO: 782 - protein, 9 aa, Artificial Sequence
  Synthetic polymer
IRSNGGYTN

SEQ ID NO: 783 - protein, 9 aa, Artificial Sequence
  Synthetic polymer
ISSSDVGTY

SEQ ID NO: 784 - protein, 9 aa, Artificial Sequence
  Synthetic polymer
INSSDGSTY

SEQ ID NO: 785 - protein, 9 aa, Artificial Sequence
  Synthetic polymer
ISGSDSSTY

SEQ ID NO: 786 - protein, 9 aa, Artificial Sequence
  Synthetic polymer
ISSSDVGTY

SEQ ID NO: 787 - protein, 8 aa, Artificial Sequence
  Synthetic polymer
ITSDGTPT

SEQ ID NO: 788 - protein, 8 aa, Artificial Sequence
  Synthetic polymer
ITSDGTPA

SEQ ID NO: 789 - protein, 9 aa, Artificial Sequence
  Synthetic polymer
IDSGGGSTS

SEQ ID NO: 790 - protein, 9 aa, Artificial Sequence
  Synthetic polymer
ISSGDGSKY

SEQ ID NO: 791 - protein, 9 aa, Artificial Sequence
  Synthetic polymer
ISSSDVGTY

SEQ ID NO: 792 - protein, 8 aa, Artificial Sequence
  Synthetic polymer
IFGGGFTN

SEQ ID NO: 793 - protein, 8 aa, Artificial Sequence
  Synthetic polymer
ITSGGITD

SEQ ID NO: 794 - protein, 9 aa, Artificial Sequence
  Synthetic polymer
ISSSDGSTY

SEQ ID NO: 795 - protein, 9 aa, Artificial Sequence
  Synthetic polymer
IDSGGGSTS

SEQ ID NO: 796 - protein, 8 aa, Artificial Sequence
  Synthetic polymer
ITSDGTPT

SEQ ID NO: 797 - protein, 9 aa, Artificial Sequence
  Synthetic polymer
IDSGGGSTS

SEQ ID NO: 798 - protein, 9 aa, Artificial Sequence
  Synthetic polymer
ISSSDVGTY

SEQ ID NO: 799 - protein, 9 aa, Artificial Sequence
  Synthetic polymer
ITWSGGSTS

SEQ ID NO: 800 - protein, 9 aa, Artificial Sequence
  Synthetic polymer
ISSSDGSTY

SEQ ID NO: 801 - protein, 9 aa, Artificial Sequence
  Synthetic polymer
IDSGGGSTS

SEQ ID NO: 802 - protein, 9 aa, Artificial Sequence
  Synthetic polymer
IRSNGGYTN

SEQ ID NO: 803 - protein, 9 aa, Artificial Sequence
  Synthetic polymer
ISSSDGSTY

SEQ ID NO: 804 - protein, 16 aa, Artificial Sequence
  Synthetic polymer
DGWSSCRHGINEYLYW

SEQ ID NO: 805 - protein, 8 aa, Artificial Sequence
  Synthetic polymer
SSGVYNYW

SEQ ID NO: 806 - protein, 12 aa, Artificial Sequence
  Synthetic polymer
QGYYCSGYGCPR

SEQ ID NO: 807 - protein, 17 aa, Artificial Sequence
  Synthetic polymer
SGWRLCRPTDEYDYSYW

SEQ ID NO: 808 - protein, 8 aa, Artificial Sequence
  Synthetic polymer
SSGVYNYW

SEQ ID NO: 809 - protein, 14 aa, Artificial Sequence
  Synthetic polymer
QGYYCSGYGCSDYW

SEQ ID NO: 810 - protein, 7 aa, Artificial Sequence
  Synthetic polymer
RDRTIWW

SEQ ID NO: 811 - protein, 8 aa, Artificial Sequence
  Synthetic polymer
SSGVYNYW

SEQ ID NO: 812 - protein, 14 aa, Artificial Sequence
  Synthetic polymer
QGYYCSGYGCSDYW

SEQ ID NO: 813 - protein, 12 aa, Artificial Sequence
  Synthetic polymer
QGYYCSGYGCYP

SEQ ID NO: 814 - protein, 15 aa, Artificial Sequence
  Synthetic polymer
DGYYYCSDYPHPLYW

SEQ ID NO: 815 - protein, 15 aa, Artificial Sequence
  Synthetic polymer
DGWRDCTWSNEYAYW

SEQ ID NO: 816 - protein, 15 aa, Artificial Sequence
  Synthetic polymer
TGWRTCRGLNEYDYW

SEQ ID NO: 817 - protein, 15 aa, Artificial Sequence
  Synthetic polymer
DGYYYCSDYPHPLYW

SEQ ID NO: 818 - protein, 8 aa, Artificial Sequence
  Synthetic polymer
SSGVYNYW

SEQ ID NO: 819 - protein, 8 aa, Artificial Sequence
  Synthetic polymer
SSGVYNYW

SEQ ID NO: 820 - protein, 14 aa, Artificial Sequence
  Synthetic polymer
QGYYCSGYGCSDYW

SEQ ID NO: 821 - protein, 15 aa, Artificial Sequence
  Synthetic polymer
DGYYYCSDYPHPLYW

SEQ ID NO: 822 - protein, 15 aa, Artificial Sequence
  Synthetic polymer
DGYYYCSDYPHPLYW

SEQ ID NO: 823 - protein, 13 aa, Artificial Sequence
  Synthetic polymer
DLVSGSSRLYDYW

SEQ ID NO: 824 - protein, 7 aa, Artificial Sequence
  Synthetic polymer
RDRTIWW

SEQ ID NO: 825 - protein, 16 aa, Artificial Sequence
  Synthetic polymer
DGWSSCRHGINEYLYW

SEQ ID NO: 826 - protein, 14 aa, Artificial Sequence
  Synthetic polymer
QGYYCSGYGCSDYW

SEQ ID NO: 827 - protein, 8 aa, Artificial Sequence
  Synthetic polymer
SSGVYNYW

SEQ ID NO: 828 - protein, 14 aa, Artificial Sequence
  Synthetic polymer
QGYYCSGYGCSDYW

SEQ ID NO: 829 - protein, 15 aa, Artificial Sequence
  Synthetic polymer
DGYYYCSDYPHPLYW

SEQ ID NO: 830 - protein, 18 aa, Artificial Sequence
  Synthetic polymer
MGRTNYGVIYDPNMYNYW

SEQ ID NO: 831 - protein, 17 aa, Artificial Sequence
  Synthetic polymer
SGWRLCRPTDEYDYLYW

SEQ ID NO: 832 - protein, 14 aa, Artificial Sequence
  Synthetic polymer
QGYYCSGYGCSDYW

SEQ ID NO: 833 - protein, 12 aa, Artificial Sequence
  Synthetic polymer
QGYYCSGYGCYP

SEQ ID NO: 834 - protein, 16 aa, Artificial Sequence
  Synthetic polymer
DGWSSCRHGINEYLYW

SEQ ID NO: 835 - protein, 143 aa, Artificial Sequence
  Synthetic polymer
QVQLQESGGGLVQAGGSLRLSCAASGFTLDYYAIGWFRQAPGKEREEVSCISSSDGSTYYADSVKGRFTISRDNAKNTVNLQMNSLKPEDTAVYYCATDGWSSCRHGINEYLYWGQGTQVTVSSAAAYPYDVPDYGSHHHHHH

SEQ ID NO: 836 - protein, 134 aa, Artificial Sequence
  Synthetic polymer
QVQLQESGGGLVQAGGSLRLSCTASGTIFSINHMDWFRQAPGKQRELVALITSDGFPTYADSAKGRFTISRDNTKKTVSLQMNSLKPEDTAVYYCHVSSGVYNYWGQGTQVTVSSAAAYPYDVPDYGSHHHHHH

SEQ ID NO: 837 - protein, 138 aa, Artificial Sequence
  Synthetic polymer
QVQLQESGGGLVQPGGSLRLSCAASGFTFDDYGMSWVRQAPGKGLEWVSAIRWNGGSTNYADSVKGRFTISRDNAKNTLYLQMNSLKSEDTAVYYCAQGYYCSGYGCPRGQGTQVTVSSAAAYPYDVPDYGSHHHHHH

SEQ ID NO: 838 - protein, 144 aa, Artificial Sequence
  Synthetic polymer
QVQLQESGGGLVQPGGSLRLSCAASGFTLDYYAINWFRQAPGKEREEVSCISSSDGSTYYADSVKGRFTISRDNAKNTVYLQMNSLKPEDTAVYYCATSGWRLCRPTDEYDYSYWGQGTQVTVSSAAAYPYDVPDYGSHHHHHH

SEQ ID NO: 839 - protein, 134 aa, Artificial Sequence
  Synthetic polymer
QVQLQESGGGVVQAGGSLRLSCTASGTIFSINRMDWFRQAPGKQRELVALITSDGTPTYADSAKGRFTISRDNTKKTVSLQMNSLKPEDTAVYYCHVSSGVYNYWGQGTQVTVSSAAAYPYDVPDYGSHHHHHH

SEQ ID NO: 840 - protein, 140 aa, Artificial Sequence
  Synthetic polymer
QVQLQESGGGLVQTGGSLRLSCAASGFTFSSYGMSWVRQTPGKGPEWVSAIDSGGGSTSYADSVKGRFTISRDNAKNTLYLQMNSLKPEDTAVYYCAQGYYCSGYGCSDYWGQGTQVTVSSAAAYPYDVPDYGSHHHHHH

SEQ ID NO: 841 - protein, 133 aa, Artificial Sequence
  Synthetic polymer
QVQLQESGGGLVQPGGSLRLSCAASGKIFSGNDMGWYRQAPGKQRELVGIITSGGITDYADAVKGRFTISRDNAKNMMYLQMNSLKPEDTAVYYCNMRDRTIWWGQGTQVTVSSAAAYPYDVPDYGSHHHHHH

SEQ ID NO: 842 - protein, 134 aa, Artificial Sequence
  Synthetic polymer
QVQLQESGGGSVQAGGSLRLSCTASGTIFSINRMDWFRQAPGKQRELVALITSDGTPTYADSAKGRFTISRDNTKKTVSLQMNSLKPEDTAVYYCHVSSGVYNYWGQGTQVTVSSAAAYPYDVPDYGSHHHHHH

SEQ ID NO: 843 - protein, 140 aa, Artificial Sequence
  Synthetic polymer
QVQLQESGGGLVQPGGSLRLSCAASGFTFSSYGMSWVRQTPGKGPEWVSAIDSGGGSTSYADSVKGRFTTSRDNAKNTLYLQMNSLKPEDTAVYYCAQGYYCSGYGCSDYWGQGTQVTVSSAAAYPYDVPDYGSHHHHHH

SEQ ID NO: 844 - protein, 138 aa, Artificial Sequence
  Synthetic polymer
QVQLQESGGGLVQPGGSLRLSCAASGFTFNDYAMSWVRQAPGKGLEWVSGIRSNGGYTNYADSVKGRFTISRDNAKNTLYLQMNSLKSEDTAVYYCAQGYYCSGYGCYPGQGTQVTVSSAAAYPYDVPDYGSHHHHHH

SEQ ID NO: 845 - protein, 142 aa, Artificial Sequence
  Synthetic polymer
QVQLQESGGGLVQAGGSLRLSCAASGFNLDPYAIAWFRQAPGKEREEVSCISSSDVGTYYADSVKGRFTISRDNAKKTVYLQMNSLKPEDTAVYYCATDGYYYCSDYPHPLYWGQGTQVTVSSAAAYPYDVPDYGSHHHHHH

SEQ ID NO: 846 - protein, 142 aa, Artificial Sequence
  Synthetic polymer
QVQLQESGGGLVQPGGSLRLSCAASGFTFTAYAMSWFRQAPGKEREEVSCINSSDGSTYYADSVKGRFTISRDNAKNTVYLQMNSLKPEDTAVYHCATDGWRDCTWSNEYAYWGQGTQVTVSSAAAYPYDVPDYGSHHHHHH

SEQ ID NO: 847 - protein, 142 aa, Artificial Sequence
  Synthetic polymer
QVQLQESGGGLVQPGGSLRLSCAASGFTFDYYAIGWFRQAPGKEREEVSCISGSDSSTYYADSVKGRFTIVRDNAQNTVYLQMNSLKPEDTAIYYCAVTGWRTCRGLNEYDYWGQGTQVTVSSAAAYPYDVPDYGSHHHHHH

SEQ ID NO: 848 - protein, 142 aa, Artificial Sequence
  Synthetic polymer
QVQLQESGGGLVQPGGSLRLSCAASGFNLDPYAIAWFRQAPGKEREEVSCISSSDVGTYYADSVKGRFTISRDNTKKTVYLQMNSLKPEDTAVYYCATDGYYYCSDYPHPLYWGQGTQVTVSSAAAYPYDVPDYGSHHHHHH

SEQ ID NO: 849 - protein, 134 aa, Artificial Sequence
  Synthetic polymer
QVQLQESGGGLVQAGESLRLSCTASGTIFSINRMDWFRQAPGKQRELVALITSDGTPTYADSAKGRFTISRDNTKKTVSLQMNSLKPEDTAVYYCHVSSGVYNYWGQGTQVTVSSAAAYPYDVPDYGSHHHHHH

SEQ ID NO: 850 - protein, 134 aa, Artificial Sequence
  Synthetic polymer
QVQLQESGGGLVQAGGSLRLSCTASGTIFSINRMDWFRQAPGKQRELVALITSDGTPAYADSAKGRFTISRDNTKKTVSLQMNSLKPEDTAVYYCHVSSGVYNYWGQGTQVTVSSAAAYPYDVPDYGSHHHHHH

SEQ ID NO: 851 - protein, 140 aa, Artificial Sequence
  Synthetic polymer
QVQLQESGGGLVQSGGSLRLSCKTSGFTFSSYGMSWVRQTPGKGPEWVSAIDSGGGSTSYADSVKGRFTISRDNAKNTLYLQMNSLKPEDTAVYYCAQGYYCSGYGCSDYWGQGTQVTVSSAAAYPYDVPDYGSHHHHHH

SEQ ID NO: 852 - protein, 142 aa, Artificial Sequence
  Synthetic polymer
QVQLQESGGGLVQPGGSLRLSCAASGFNLDPYAIGWFRQAPGKEREEVSCISSGDGSKYYADSVKGRFTMSRDNAKKTVYLQMNSLKPEDTAVYYCATDGYYYCSDYPHPLYWGQGTQVTVSSAAAYPYDVPDYGSHHHHHH

SEQ ID NO: 853 - protein, 142 aa, Artificial Sequence
  Synthetic polymer
QVQLQESGGGLVQPGGSLRLSCAVSGFNLDPYAIAWFRQAPGKEREEVSCISSSDVGTYYADSVKGRFTISRDNAKKTVYLQMNSLKPEDTAVYYCATDGYYYCSDYPHPLYWGQGTQVTVSSAAAYPYDVPDYGSHHHHHH

SEQ ID NO: 854 - protein, 139 aa, Artificial Sequence
  Synthetic polymer
QVQLQESGGGLVQAGGSLRLSCAASESIFSIEAMGWYRQAPGKQRELVAAIFGGGFTNYADSVKGRFTISRDNANRTVYLQMNSLKPEDTAVYYCNADLVSGSSRLYDYWGQGTQVTVSSAAAYPYDVPDYGSHHHHHH

SEQ ID NO: 855 - protein, 133 aa, Artificial Sequence
  Synthetic polymer
QVQLQESGGGLVQAGGSLRLSCAASGKIFSGNDMGWYRQAPGKQRELVGIITSGGITDYADAVKGRFTISRDNAKNMMYLQMNSLKPEDTAVYYCNMRDRTIWWGQGTQVTVSSAAAYPYDVPDYGSHHHHHH

SEQ ID NO: 856 - protein, 143 aa, Artificial Sequence
  Synthetic polymer
QVQLQESGGGLVQPGGSLRLSCAASGFTLDYYAIGWFRQAPGKEREEVSCISSSDGSTYYADSVKGRFTISRDNAKNTVNLQMNSLKPEDTAVYYCATDGWSSCRHGINEYLYWGQGTQVTVSSAAAYPYDVPDYGSHHHHHH

SEQ ID NO: 857 - protein, 140 aa, Artificial Sequence
  Synthetic polymer
QVQLQESGGGLVQAGGSLRLSCAASGFTFSSYGMSWVRQTPGKGPEWVSAIDSGGGSTSYADSVKGRFTISRDNAKNTLYLQMNSLKPEDTAVYYCAQGYYCSGYGCSDYWGQGTQVTVSSAAAYPYDVPDYGSHHHHHH

SEQ ID NO: 858 - protein, 134 aa, Artificial Sequence
  Synthetic polymer
QVQLQESGGGLVQPGGSLRLSCTASGTIFSINRMDWFRQAPGKQRELVALITSDGTPTYADSAKGRFTISRDNTKKTVSLQMNSLKPEDTAVYYCHVSSGVYNYWGQGTQVTVSSAAAYPYDVPDYGSHHHHHH

SEQ ID NO: 859 - protein, 140 aa, Artificial Sequence
  Synthetic polymer
QVQLQESGGGLVQPGGSLRLSCAASGFTFSSYGMSWVRQTPGKGPEWVSAIDSGGGSTSYADSVKGRFTISRDNAKNTLYLQMNSLKPEDTAVYYCAQGYYCSGYGCSDYWGQGTQVTVSSAAAYPYDVPDYGSHHHHHH

SEQ ID NO: 860 - protein, 142 aa, Artificial Sequence
  Synthetic polymer
QVQLQESGGGLVQPGGSLRLSCAASGFNLDPYAIAWFRQAPGKEREEVSCISSSDVGTYYADSVKGRFTISRDNAKKTVYLQMNSLKPEDTAVYYCATDGYYYCSDYPHPLYWGQGTQVTVSSAAAYPYDVPDYGSHHHHHH

SEQ ID NO: 861 - protein, 145 aa, Artificial Sequence
  Synthetic polymer
  misc_feature (13)..(13): Xaa can be any naturally occurring amino acid
QVQLQESGGGLVXAGGSLRLSCAASGRTFSISAMGWFRQAPGKEREFVAAITWSGGSTSYTDSVKGRFTISRDNAKNTLYLQMNSLKPEDTAIYYCAAMGRTNYGVIYDPNMYNYWGQGTQVTVSSAAAYPYDVPDYGSHHHHHH

SEQ ID NO: 862 - protein, 144 aa, Artificial Sequence
  Synthetic polymer
QVQLQESGGGLVQPGGSLRLSCAASGFTLDYYAINWFRQAPGKEREEVSCISSSDGSTYYADSVKGRFTISRDNAKNTVYLQMNSLKPEDTAVYYCATSGWRLCRPTDEYDYLYWGQGTQVTVSSAAAYPYDVPDYGSHHHHHH

SEQ ID NO: 863 - protein, 140 aa, Artificial Sequence
  Synthetic polymer
QVQLQESGGGLVQAGGSMRLSCAASGFTFSSYGMSWVRQTPGKGPEWVSAIDSGGGSTSYADSVKGRFTISRDNAKNTLYLQMNSLKPEDTAVYYCAQGYYCSGYGCSDYWGQGTQVTVSSAAAYPYDVPDYGSHHHHHH

SEQ ID NO: 864 - protein, 138 aa, Artificial Sequence
  Synthetic polymer
QVQLQESGGGTVQAGGSLRLSCAASGFTFNDYAMSWVRQAPGKGLEWVSGIRSNGGYTNYADSVKGRFTISRDNAKNTLYLQMNSLKSEDTAVYYCAQGYYCSGYGCYPGQGTQVTVSSAAAYPYDVPDYGSHHHHHH

SEQ ID NO: 865 - protein, 143 aa, Artificial Sequence
  Synthetic polymer
QVQLQESGGGLVQPGTSLRLSCAASGFTLDYYAIGWFRQAPGKEREEVSCISSSDGSTYYADSVKGRFTISRDNAKNTVNLQMNSLKPEDTAVYYCATDGWSSCRHGINEYLYWGQGTQVTVSSAAAYPYDVPDYGSHHHHHH

SEQ ID NO: 866 - protein, 451 aa, Artificial Sequence
  Synthetic polymer
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 867 - protein, 215 aa, Artificial Sequence
  Synthetic polymer
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 868 - protein, 121 aa, Artificial Sequence
  Synthetic polymer
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSS

SEQ ID NO: 869 - protein, 108 aa, Artificial Sequence
  Synthetic polymer
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIK

SEQ ID NO: 870 - protein, 448 aa, Artificial Sequence
  Synthetic polymer
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 871 - protein, 214 aa, Artificial Sequence
  Synthetic polymer
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 872 - protein, 450 aa, Artificial Sequence
  Synthetic polymer
EVQLLESGGGLVQPGGSLRLSCAASGFTFSSYIMMWVRQAPGKGLEWVSSIYPSGGITFYADTVKGRFTISRDNSKNTLYLQMNSLRAEDTAVYYCARIKLGTVTTVDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 873 - protein, 216 aa, Artificial Sequence
  Synthetic polymer
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 874 - protein, 123 aa, Artificial Sequence
  Synthetic polymer
QVQLVQSGAEVKKPGSSVKVSCKTSGDTFSTYAISWVRQAPGQGLEWMGGIIPIFGKAHYAQKFQGRVTITADESTSTAYMELSSLRSEDTAVYFCARKFHFVSGSPFGMDVWGQGTTVTVSS

SEQ ID NO: 875 - protein, 106 aa, Artificial Sequence
  Synthetic polymer
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIK

SEQ ID NO: 876 - protein, 117 aa, Artificial Sequence
  Synthetic polymer
QVQLVQSGAEVKKPGASVKVSCKASGYTFTDYGFSWVRQAPGQGLEWMGWITAYNGNTNYAQKLQGRVTMTTDTSTSTVYMELRSLRSDDTAVYYCARDYFYGMDVWGQGTTVTVSS

SEQ ID NO: 877 - protein, 107 aa, Artificial Sequence
  Synthetic polymer
EIVLTQSPATLSLSPGERATLSCRASQSVSSYLVWYQQKPGQAPRLLIYDASNRATGIPARFSGSGSGTDFTLTISSLEPEDFAVYYCQQRSNWPRTFGQGTKVEIK

SEQ ID NO: 878 - protein, 118 aa, Artificial Sequence
  Synthetic polymer
QVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSS

SEQ ID NO: 879 - protein, 107 aa, Artificial Sequence
  Synthetic polymer
DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIK

SEQ ID NO: 880 - protein, 120 aa, Artificial Sequence
  Synthetic polymer
QVQLVQSGAEVKKPGSSVKVSCKVSGGIFSTYAINWVRQAPGQGLEWMGGIIPIFGTANHAQKFQGRVTITADESTSTAYMELSSLRSEDTAVYYCARDQGIAAALFDYWGQGTLVTVSS

SEQ ID NO: 881 - protein, 108 aa, Artificial Sequence
  Synthetic polymer
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 882 - protein, 113 aa, Artificial Sequence
  Synthetic polymer
EVQLVESGGGLVQPGRSLRLSCAVSGFTFDDYVVHWVRQAPGKGLEWVSGISGNSGNIGYADSVKGRFTISRDNAKNSLYLQMNSLRAEDTALYYCAVPFDYWGQGTLVTVSS

SEQ ID NO: 883 - protein, 107 aa, Artificial Sequence; identical to SEQ ID NO: 879
  Synthetic polymer

SEQ ID NO: 884 - protein, 123 aa, Artificial Sequence
  Synthetic polymer
QVQLVQSGAEVKKPGSSVKVSCKTSGDTFSSYAISWVRQAPGQGLEWMGGIIPIFGRAHYAQKFQGRVTITADESTSTAYMELSSLRSEDTAVYFCARKFHFVSGSPFGMDVWGQGTTVTVSS

SEQ ID NO: 885 - protein, 106 aa, Artificial Sequence; identical to SEQ ID NO: 875
  Synthetic polymer

SEQ ID NO: 886 - protein, 123 aa, Artificial Sequence
  Synthetic polymer
QVQLVQSGAEVKKPGSSVKVSCKTSGGTFSSYAISWVRQAPGQGLEWMGGIIPIFGKAHYAQKFQGRVTITADESTTTAYMELSSLRSEDTAVYYCARKYDYVSGSPFGMDVWGQGTTVTVSS

SEQ ID NO: 887 - protein, 106 aa, Artificial Sequence; identical to SEQ ID NO: 875
  Synthetic polymer

SEQ ID NO: 888 - protein, 121 aa, Artificial Sequence
  Synthetic polymer
QVQLVQSGAEVKKPGSSVKVSCKASGGTFSSYAINWVRQAPGQGLEWMGGIIPIFGSANYAQKFQDRVTITADESTSAAYMELSSLRSEDTAVYYCARDSSGWSRYYMDVWGQGTTVTVSS

SEQ ID NO: 889 - protein, 106 aa, Artificial Sequence
  Synthetic polymer
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFGGGTKVEIK

SEQ ID NO: 890 - protein, 123 aa, Artificial Sequence
  Synthetic polymer
QVQLVQSGAEVKEPGSSVKVSCKASGGTFNSYAISWVRQAPGQGLEWMGGIIPLFGIAHYAQKFQGRVTITADESTNTAYMDLSSLRSEDTAVYYCARKYSYVSGSPFGMDVWGQGTTVTVSS

SEQ ID NO: 891 - protein, 106 aa, Artificial Sequence
  Synthetic polymer
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTRLEIK

SEQ ID NO: 892 - protein, 121 aa, Artificial Sequence
  Synthetic polymer
EVQLVESGGGLVQPGRSLRLSCAASGITFDDYGMHWVRQAPGKGLEWVSGISWNRGRIEYADSVKGRFTISRDNAKNSLYLQMNSLRAEDTALYYCAKGRFRYFDWFLDYWGQGTLVTVSS

SEQ ID NO: 893 - protein, 107 aa, Artificial Sequence
  Synthetic polymer
AIQLTQSPSSLSASVGDRVTITCRASQGISSALAWYQQKPGKAPKLLIYDASSLESGVPSRFSGSGSGTDFTLTISSLQPEDFATYYCQQFNSYPFTFGPGTKVDIK

SEQ ID NO: 894 - protein, 118 aa, Artificial Sequence
  Synthetic polymer
EVKLQESGPSLVKPSQTLSLTCSVTGYSITSDYWNWIRKFPGNKLEYVGYISYTGSTYYNPSLKSRISITRDTSKNQYYLQLNSVTSEDTATYYCARYGGWLSPFDYWGQGTTLTVSS

SEQ ID NO: 895 - protein, 107 aa, Artificial Sequence
  Synthetic polymer
DIVMTQSHKLMSTSVGDRVSITCKASQDVGTAVAWYQQKPGQSPKLLIYWASTRHTGVPDRFTGSGSGTDFTLTISNVQSEDLADYFCQQDSSYPLTFGAGTKVELK

SEQ ID NO: 896 - protein, 120 aa, Artificial Sequence
  Synthetic polymer
EVQLQESGPGLVAPSQSLSITCTVSGFSLTTYSINWIRQPPGKGLEWLGVMWAGGGTNSNSVLKSRLIISKDNSKSQVFLKMNSLQTDDTARYYCARYYGNSPYYAIDYWGQGTSVTVSS

SEQ ID NO: 897 - protein, 107 aa, Artificial Sequence
  Synthetic polymer
DIVTTQSHKLMSTSVGDRVSITCKASQDVGTAVAWYQQKPGQSPKLLIYWASTRHTGVPDRFTGSGSGTDFTLTISNVQSEDLADYFCQQDSSYPLTFGAGTKVELK

SEQ ID NO: 898 - protein, 118 aa, Artificial Sequence
  Synthetic polymer
EVKLQESGPSLVKPSQTLSLTCSVTGYSIISDYWNWIRKFPGNKLEYLGYISYTGSTYYNPSLKSRISITRDTSKNQYYLQLNSVTTEDTATYYCARRGGWLLPFDYWGQGTTLTVSS

SEQ ID NO: 899 - protein, 113 aa, Artificial Sequence
  Synthetic polymer
DIVMTQSPSSLAVSVGEKVSMGCKSSQSLLYSSNQKNSLAWYQQKPGQSPKLLIDWASTRESGVPDRFTGSGSGTDFTLTISSVKAEDLAVYYCQQYYGYPLTFGAGTKLELK

SEQ ID NO: 900 - protein, 118 aa, Artificial Sequence
  Synthetic polymer
EVKLQESGPSLVKPGASVKLSCKASGYTFTSYDINWVKQRPGQGLEWIGWIFPRDNNTKYNENFKGKATLTVDTSSTTAYMELHSLTSEDSAVYFCTKENWVGDFDYWGQGTTLTLSS

SEQ ID NO: 901 - protein, 106 aa, Artificial Sequence
  Synthetic polymer
DIVMTQSPAIMSASPGEKVTMTCSASSSIRYMHWYQQKPGTSPKRWISDTSKLTSGVPARFSGSGSGTSYALTISSMEAEDAATYYCHQRSSYPWTFGGGTKLEIK

SEQ ID NO: 902 - protein, 114 aa, Artificial Sequence
  Synthetic polymer
EVQLQQSGPDLVTPGASVRISCQASGYTFPDYYMNWVKQSHGKSLEWIGDIDPNYGGTTYNQKFKGKAILTVDRSSSTAYMELRSLTSEDSAVYYCARGALTDWGQGTSLTVSS

SEQ ID NO: 903 - protein, 106 aa, Artificial Sequence
  Synthetic polymer
QIVLSQSPAILSASPGEKVTMTCRASSSVSYIYWFQQKPGSSPKPWIYATFNLASGVPARFSGSGSGTSYSLTISRVETEDAATYYCQQWSNNPLTFGAGTKLELK

SEQ ID NO: 904 - protein, 115 aa, Artificial Sequence
  Synthetic polymer
EVQLVQSGPELKKPGASVKMSCKASGYTFTSYVMHWVKQAPGQRLEWIGYVNPFNDGTKYNEMFKGRATLTSDKSTSTAYMELSSLRSEDSAVYYCARQAWGYPWGQGTLVTVSS

SEQ ID NO: 905 - protein, 115 aa, Artificial Sequence
  Synthetic polymer
EVQLVQSGAEVKKPGASVKMSCKASGYTFTSYVMHWVKQAPGQRLEWIGYVNPFNDGTKYNEMFKGRATLTSDKSTSTAYMELSSLRSEDTAVYYCARQAWGYPWGQGTLVTVSS

SEQ ID NO: 906 - protein, 115 aa, Artificial Sequence
  Synthetic polymer
EVQLVQSGAEVKKPGASVKMSCKASGYTFTSYVMHWVRQAPGQRLEWIGYVNPFNDGTKYNEMFKGRATLTSDKSTSTAYMELSSLRSEDTAVYYCARQAWGYPWGQGTLVTVSS

SEQ ID NO: 907 - protein, 115 aa, Artificial Sequence
  Synthetic polymer
EVQLVQSGAEVKKPGASVKVSCKASGYTFTSYVMHWVRQAPGQRLEWIGYVNPFNDGTKYNEMFKGRATLTSDKSTSTAYMELSSLRSEDTAVYYCARQAWGYPWGQGTLVTVSS

SEQ ID NO: 908 - protein, 115 aa, Artificial Sequence
  Synthetic polymer
EVQLVQSGAEVKKPGASVKVSCKASGYTFTSYVMHWVRQAPGQRLEWIGYVNPFNDGTKYNEMFKGRATITSDKSTSTAYMELSSLRSEDTAVYYCARQAWGYPWGQGTLVTVSS

SEQ ID NO: 909 - protein, 111 aa, Artificial Sequence
  Synthetic polymer
DIVLTQSPASLALSPGERATLSCRATESVEYYGTSLVQWYQQKPGQPPKLLIYAASSVDSGVPSRFSGSGSGTDFTLTINSLEEEDAAMYFCQQSRRVPYTFGQGTKLEIK

SEQ ID NO: 910 - protein, 111 aa, Artificial Sequence
  Synthetic polymer
DIVLTQSPATLSLSPGERATLSCRATESVEYYGTSLVQWYQQKPGQPPKLLIYAASSVDSGVPSRFSGSGSGTDFTLTINSLEAEDAAMYFCQQSRRVPYTFGQGTKLEIK

SEQ ID NO: 911 - protein, 111 aa, Artificial Sequence
  Synthetic polymer
EIVLTQSPATLSLSPGERATLSCRATESVEYYGTSLVQWYQQKPGQPPKLLIYAASSVDSGVPSRFSGSGSGTDFTLTINSLEAEDAAMYFCQQSRRVPYTFGQGTKLEIK

SEQ ID NO: 912 - protein, 111 aa, Artificial Sequence
  Synthetic polymer
DIVLTQSPATLSLSPGERATLSCRATESVEYYGTSLVQWYQQKPGQPPKLLIYAASSVDSGVPSRFSGSGSGTDFTLTINSLEAEDAATYFCQQSRRVPYTFGQGTKLEIK

SEQ ID NO: 913 - protein, 228 aa, Artificial Sequence
  Synthetic polymer
EVQLVESGGGLVKPGGSLRLSCAASGFTFSTYSMNWVRQAPGKGLEWVSSISSSGDYIYYADSVKGRFTISRDNAKNSLFLQMNSLKAEDTAVYYCARDLVTSMVAFDYWGQGTLVTVSSSYELTQPPSVSVSPGQAARITCSGDALPQKYVFWYQQKSGQAPVLVIYEDSKRPSGIPERFSGSSSGTMATLTISGAQVEDEADYYCYSTDRSGNHRVFGGGTRLTVL

SEQ ID NO: 914 - protein, 228 aa, Artificial Sequence
  Synthetic polymer
EVQLVESGGGLVQPGGSLRLSCAASGFTFSSYWMSWVRQAPGKGLEWVANIKQDGGEQYYVDSVKGRFTISRDNAKNSLYLQMNSLRAEDTAVYYCARDWNYGYYDMDVWGQGTTVTVSSEIVLTQSPGTLSLSPGERATLSCRASQSVSSNYLAWFQQKPGQAPRLLIFGTSSRATGIPDRFSGSGSGTDFTLTISRLEPEDFAVYYCQQYGSSIFTFGPGTKVDIK

SEQ ID NO: 915 - protein, 121 aa, Artificial Sequence; identical to SEQ ID NO: 868
  Synthetic polymer

SEQ ID NO: 916 - protein, 108 aa, Artificial Sequence
  Synthetic polymer
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTEVEIK

SEQ ID NO: 917 - protein, 121 aa, Artificial Sequence
  Synthetic polymer
EVQLLESGGGLVQPGGSLRLSCAASGFTFSNYAMSWVRQAPGKGLEWVSAIRGSGGSTYYADSVKGRFTISRDNSKNTLYLQMNSLRAEDTAVYYCAKDLHYDSSGYLDYWGQGTLVTVSS

SEQ ID NO: 918 - protein, 107 aa, Artificial Sequence
  Synthetic polymer
DIQMTQSPSSVSASVGDRVTITCRASQGIRSWLAWYQQKPGKAPKLLIYAISRLQSGVPSRFSGSGSGTDFTLTISSLQPEDFATYYCQQANSFPLTFGGGTKVEIK

SEQ ID NO: 919 - protein, 119 aa, Artificial Sequence
  Synthetic polymer
EVQLVESGGGLVQPGGSLRLSCAASGFTFSSYWMSWVRQAPGKGLEWVANIKQDGGEKYYVDSVKGRFTISRDNAKNSLFLQMNSLRAEDTAVYYCARVQLYSDYFDYWGQGTLVTVSS

SEQ ID NO: 920 - protein, 107 aa, Artificial Sequence
  Synthetic polymer
DIQMTQSPSSVSASVGDRVTITCRASQGISSWLAWYQQKSGKAPKLLIYAASGLQSGVPSRFSGSGSGTDFTLTISSLQPEDLATYYCQQSHSLPPTFGQGTKVEIK

SEQ ID NO: 921 - protein, 121 aa, Artificial Sequence
  Synthetic polymer
EVQLLESGGDLVQPGGSLRLSCAASGFTFNSYAMSWVRQAPGKGLEWVSTISGSGGFTFSADSVKGRFTISRDNSKNTLFLQMNSLRVEDSAVYSCAKVLVGFNNGCWDYWGQGTLVTVSS

SEQ ID NO: 922 - protein, 108 aa, Artificial Sequence
  Synthetic polymer
SYVLTQPPSVSVAPGQTARITCGGNNIGSKSVHWYQQKPGQAPVLVVYDDSDRPSGIPERFSGSNSGNTATLTISRVEAGDEADYYCQVWDSSNDHVVFGGGTKLTVL

SEQ ID NO: 923 - protein, 120 aa, Artificial Sequence
  Synthetic polymer
EVQLVESGGGLVKPGGSLRLSCAASGFTFSTYSMNWVRQAPGKGLEWVSSISSSGDYIYYADSVKGRFTISRDNAKNSLYLQMNSLRAEDTAVYYCARDLVTSMVAFDYWGQGTLVTVSS

SEQ ID NO: 924 - protein, 108 aa, Artificial Sequence
  Synthetic polymer
SYELTQPPSVSVSPGQTARITCSGDALPQKYVFWYQQKSGQAPVLVIYEDSKRPSGIPERFSGSSSGTMATLTISGAQVEDEADYYCYSTDRSGNHRVFGGGTKLTVL

SEQ ID NO: 925 - protein, 121 aa, Artificial Sequence; identical to SEQ ID NO: 868
  Synthetic polymer

SEQ ID NO: 926 - protein, 108 aa, Artificial Sequence; identical to SEQ ID NO: 869
  Synthetic polymer

SEQ ID NO: 927 - protein, 120 aa, Artificial Sequence
  Synthetic polymer
QVQLVQSGAEVKKPGASVKVSCKASGYTFTSYWMYWVRQATGQGLEWMGRIDPNSGSTKYNEKFKNRFTISRDDSKNTAYLQMNSLKTEDTAVYYCARDYRKGLYAMDYWGQGTTVTVSS

SEQ ID NO: 928 - protein, 120 aa, Artificial Sequence
  Synthetic polymer
EVQLVQSGAEVKKPGATVKISCKVSGYTFTSYWMYWVRQATGQGLEWMGRIDPNSGSTKYNEKFKNRVTITADKSTSTAYMELSSLRSEDTAVYYCARDYRKGLYAMDYWGQGTTVTVSS

SEQ ID NO: 929 - protein, 120 aa, Artificial Sequence
  Synthetic polymer
EVQLVQSGAEVKKPGESLRISCKGSGYTFTSYWMYWVRQAPGQGLEWMGRIDPNSGSTKYNEKFKNRVTISVDTSKNQFSLKLSSVTAADTAVYYCARDYRKGLYAMDYWGQGTTVTVSS

SEQ ID NO: 930 - protein, 120 aa, Artificial Sequence
  Synthetic polymer
EVQLVQSGAEVKKPGATVKISCKVSGYTFTSYWMYWIRQSPSRGLEWLGRIDPNSGSTKYNEKFKNRLTISKDTSKNQVVLTMTNMDPVDTATYYCARDYRKGLYAMDYWGQGTTVTVSS

SEQ ID NO: 931 - protein, 120 aa, Artificial Sequence
  Synthetic polymer
EVQLVQSGAEVKKPGESLRISCKGSGYTFTSYWMYWIRQPPGKGLEWIGRIDPNSGSTKYNEKFKNRVTITADKSTSTAYMELSSLRSEDTAVYYCARDYRKGLYAMDYWGQGTTVTVSS

SEQ ID NO: 932 - protein, 120 aa, Artificial Sequence
  Synthetic polymer
QVQLVQSGAEVKKPGASVKVSCKASGYTFTSYWMYWIRQSPSRGLEWLGRIDPNSGSTKYNEKFKNRFTISRDDSKNTAYLQMNSLKTEDTAVYYCARDYRKGLYAMDYWGQGTTVTVSS

SEQ ID NO: 933 - protein, 120 aa, Artificial Sequence
  Synthetic polymer
EVQLVQSGAEVKKPGESLRISCKGSGYTFTSYWMYWVRQARGQRLEWIGRIDPNSGSTKYNEKFKNRLTISKDTSKNQVVLTMTNMDPVDTATYYCARDYRKGLYAMDYWGQGTTVTVSS

SEQ ID NO: 934 - protein, 120 aa, Artificial Sequence
  Synthetic polymer
QITLKESGPTLVKPTQTLTLTCTFSGYTFTSYWMYWVRQAPGKGLEWVSRIDPNSGSTKYNEKFKNRVTITADKSTSTAYMELSSLRSEDTAVYYCARDYRKGLYAMDYWGQGTTVTVSS

SEQ ID NO: 935 - protein, 120 aa, Artificial Sequence
  Synthetic polymer
EVQLVQSGAEVKKPGATVKISCKVSGYTFTSYWMYWVRQARGQRLEWIGRIDPNSGSTKYNEKFKNRFTISRDNSKNTLYLQMNSLRAEDTAVYYCARDYRKGLYAMDYWGQGTTVTVSS

SEQ ID NO: 936 - protein, 107 aa, Artificial Sequence
  Synthetic polymer
DIVMTQTPLSLPVTPGEPASISCKASQDVGTAVAWYLQKPGQSPQLLIYWASTRHTGIPARFSGSGSGTEFTLTISSLQSEDFAVYYCQQYNSYPLTFGQGTKVEIK

SEQ ID NO: 937 - protein, 107 aa, Artificial Sequence
  Synthetic polymer
DIQMTQSPSSLSASVGDRVTITCKASQDVGTAVAWYLQKPGQSPQLLIYWASTRHTGVPSRFSGSGSGTDFTLTISSLQPEDFATYYCQQYNSYPLTFGQGTKVEIK

SEQ ID NO: 938 - protein, 107 aa, Artificial Sequence
  Synthetic polymer
EIVLTQSPDFQSVTPKEKVTITCKASQDVGTAVAWYLQKPGQSPQLLIYWASTRHTGVPDRFSGSGSGTDFTLKISRVEAEDVGVYYCQQYNSYPLTFGQGTKVEIK

SEQ ID NO: 939 - protein, 107 aa, Artificial Sequence
  Synthetic polymer
EIVLTQSPDFQSVTPKEKVTITCKASQDVGTAVAWYLQKPGQSPQLLIYWASTRHTGVPSRFSGSGSGTDFTFTISSLQPEDIATYYCQQYNSYPLTFGQGTKVEIK

SEQ ID NO: 940 - protein, 107 aa, Artificial Sequence
  Synthetic polymer
EIVLTQSPATLSLSPGERATLSCKASQDVGTAVAWYLQKPGQSPQLLIYWASTRHTGIPPRFSGSGYGTDFTLTINNIESEDAAYYFCQQYNSYPLTFGQGTKVEIK

SEQ ID NO: 941 - protein, 107 aa, Artificial Sequence
  Synthetic polymer
DVVMTQSPLSLPVTLGQPASISCKASQDVGTAVAWYQQKPGQAPRLLIYWASTRHTGVPSRFSGSGSGTEFTLTISSLQPDDFATYYCQQYNSYPLTFGQGTKVEIK

SEQ ID NO: 942 - protein, 107 aa, Artificial Sequence
  Synthetic polymer
DIQMTQSPSSLSASVGDRVTITCKASQDVGTAVAWYQQKPGQAPRLLIYWASTRHTGVPSRFSGSGSGTDFTFTISSLQPEDIATYYCQQYNSYPLTFGQGTKVEIK

SEQ ID NO: 943 - protein, 107 aa, Artificial Sequence
  Synthetic polymer
AIQLTQSPSSLSASVGDRVTITCKASQDVGTAVAWYLQKPGQSPQLLIYWASTRHTGVPSRFSGSGSGTDFTFTISSLEAEDAATYYCQQYNSYPLTFGQGTKVEIK

SEQ ID NO: 944 - protein, 107 aa, Artificial Sequence
  Synthetic polymer
EIVLTQSPDFQSVTPKEKVTITCKASQDVGTAVAWYQQKPGQAPRLLIYWASTRHTGVPSRFSGSGSGTEFTLTISSLQPDDFATYYCQQYNSYPLTFGQGTKVEIK

SEQ ID NO: 945 - protein, 116 aa, Artificial Sequence
  Synthetic polymer
EVKLVESGGGLVKPGGSLKLSCAASGFIFRSYGMSWVRQTPEKRLEWVASISSGGSTYYPDSVKGRFTISRDNARNILYLQMSSLRSEDTAMYDCARGYDSGFAYWGQGTLVTVSE

SEQ ID NO: 946 - protein, 116 aa, Artificial Sequence
  Synthetic polymer
EVKLVESGGGLVKPGGSLKLSCAASGFTFRSYGMSWVRQTPEKRLEWVASISSGGTTYYPDSVKGRFIISRDNARNILYLQMSSLRSEDTAMYYCAKGYDSGFAYWGQGTLVIVSA

SEQ ID NO: 947 - protein, 116 aa, Artificial Sequence
  Synthetic polymer
QVQLKQSGPGLVQPSQSLSITCTVSGFSLTTYGVHWVRQSPGKGLEWLGVIWRGVTTDYNAAFMSRLTITKDNSKSQVFFKMNSLQANDTAIYYCARLGFYAMDYWGQGTSVTVSS

SEQ ID NO: 948 - protein, 116 aa, Artificial Sequence
  Synthetic polymer
QVQLKQSGPGLVQPSQSLSITCTVSGFSLTSYGVHWVRQSPGKGLEWLGVIWSGGVTDYNAAFISRLSISKDNSKSQVFFKMNSLQANDTAIYYCARLGFYAMDYWGQGTSVTVSS

SEQ ID NO: 949 - protein, 119 aa, Artificial Sequence
  Synthetic polymer
EVKLFESGGGLVQPGGSLKLSCVASGFDFSTYWMHWVRQAPGQGLEWIGQINPDSTTINYAPSLKDRFIISRDNAKNTLFLQMSKVRSEDTALYYCAKPGDYGYDFDCWGQGTTLTVSS

SEQ ID NO: 950 - protein, 119 aa, Artificial Sequence
  Synthetic polymer
EVQLQESGPSLVKPSQTLSLTCSVTGDSITSGYWNWIRKFPGNKLEYMGYISYSGSTYYNPSLKSRISITRDTSKNQYYLQLNSVTTEDTATYYCARSLLWFSTGFAYWGQGTLVTVSA

SEQ ID NO: 951 - protein, 116 aa, Artificial Sequence
  Synthetic polymer
QVQLKQSGPGLVQPSQSLSITCTVSGFSLTSYGVHWVRQSPGKGLEWLGVIWSGGITDYNAAFKSRLSISKDNSKSQVFFKMNSLQANDTAIYFCARLGFYAMDYWGQGTSVTVSS

SEQ ID NO: 952 - protein, 116 aa, Artificial Sequence
  Synthetic polymer
EVKLVESGGGLVKPGGSLKLSCAASGFTFRSYGMSWARQIPEKRLEWVASISSGGTTYYLGSVQGRFTISRDNARNILYLQMSSLRSEDTAMYYCARGYDAGFAYWGQGTLVSVSE

SEQ ID NO: 953 - protein, 117 aa, Artificial Sequence
  Synthetic polymer
EVQLQESGPSLVKPSQTLSLTCSVTGDSITSGYWTWIRKFPGNKLEYMGYISYTGSTYYNPSLKSRISISRDTSKSQYYLQLNSVTTEDTATYYCARQRDWLGFAYWGQGTLVTVSA

SEQ ID NO: 954 - protein, 116 aa, Artificial Sequence
  Synthetic polymer
EEKLVESGGGLVKPGGSLKLSCAASGFSFSSYGMSWVRQTPEKRLEWVASISSGGSIYYPDSVKGRFTISRDNARNILYLQMSSLRSEDTAMYYCARGYDAGFAFWGQGTLVTASA

SEQ ID NO: 955 - protein, 116 aa, Artificial Sequence
  Synthetic polymer
QITLKESGPTLVKPTQTLTLTCTVSGFSLSTYGVHWIRQPPGKALEWLGVIWRGVTTDYNAAFMSRLTITKDNSKNQVVLTMNNMDPVDTATYYCARLGFYAMDYWGQGTLVTVSS

SEQ ID NO: 956 - protein, 116 aa, Artificial Sequence
  Synthetic polymer
EVQLVESGGGLVKPGGSLRLSCAASGFIFRSYGMSWVRQAPGKGLEWVASISSGGSTYYPDSVKGRFTISRDNAKNSLYLQMNSLRAEDTAVYDCARGYDSGFAYWGQGTLVTVSS

SEQ ID NO: 957 - protein, 112 aa, Artificial Sequence
  Synthetic polymer
DIVLTQSPASLAVSLGQRATISCRASQSVSTSSSSFMHWYQQKPGQPPKLLIKYASNLESGVPARFSGSGSGTDFTLNIHPVEEEDTATYYCQHSWEIPYTFGGGTKLEIKR

SEQ ID NO: 958 - protein, 111 aa, Artificial Sequence
  Synthetic polymer
DIVLTQSPPSLAVSLGQRATISCRASQSVSTSSSSYMHWYQQKPGQPPKLLIKYASNLESGVPARFSGSGSGTDFTLNIHPVEEEDTATYYCQHSWEIPYTFGGGTKLEIK

SEQ ID NO: 959 - protein, 107 aa, Artificial Sequence
  Synthetic polymer
SIVMTQTPKFLLVSAGDRVTITCKASQSVSNDVAWYQQKPGQSPKLLIYYAANRYTGVPDRFTGSGYGTDFTFTISIVQAEDLAVYFCQQDYTSPYTFGGGTKLEIK

SEQ ID NO: 960 - protein, 107 aa, Artificial Sequence
  Synthetic polymer
SIVMTQTPKFLLVSAGDRVTITCKASQSVSNDVGWYQQKPGQSPKLLIYYASNRYSGVPDRFTGSGYGTDFTFTISTVQAEDLAVYFCQQDYTSPYTFGGGTKLEIK

SEQ ID NO: 961 - protein, 112 aa, Artificial Sequence
  Synthetic polymer
DVLMTQTPLYLPVSLGDQASISCRSSQIIVHSNANTYLEWFLQKPGQSPKLLIYKVSNRFSGVPDRFSGSGSGTDFTLKISRVEAEDLGVYYCFQGSHVPYTFGGGTKLEIK

SEQ ID NO: 962 - protein, 108 aa, Artificial Sequence
  Synthetic polymer
QIVLTQSPAIMSASPGEKVTLTCSASSSVSSSYLYWNQQKPGSSPKVWIYNTSNLASGVPARFSGSGSGTSYSLTISSMEAEDAASYFCHQWRSYPPTLGAGTKLELK

SEQ ID NO: 963 - protein, 106 aa, Artificial Sequence
  Synthetic polymer
QIVLTQSPAIMSASPGEKVTMTCSANSSVSYMHWYQQKSGTSPKRWIYDTSKLASGVPARFSGSGSGTSYSLTISSMGAEDAATYYCQQWSSNPWTFGGGTKLEIK

SEQ ID NO: 964 - protein, 111 aa, Artificial Sequence
  Synthetic polymer
DIVLTQSPASLAVSLGQRATISCRASQSVSTSSYSYMHWYQQKPGQPPKLLIKYASNLESGVPARFSGSGSGTDFTLNIHPVEEEDTATYYCQNSWEIPYTFGGGTKLEIK

SEQ ID NO: 965 - protein, 113 aa, Artificial Sequence
  Synthetic polymer
DIVMTQTPSSLAVSLGEKVTMSCKSSQSLLYSSNQKNSLAWYQQKPGQSPKLLIYWASNRESGVPDRFTGSSSGTDFTLTISSVKAEDLAVYYCQQYYSYPLTFGAGTKLELK

SEQ ID NO: 966 - protein, 111 aa, Artificial Sequence
  Synthetic polymer
DIVLTQSPASLAVSLGQRATISCRASQSVSTSSYSYVHWYQQKPGQPPKLLIKYASNLESGVPARFSGSGSGTDFTLNIHPVEEEDTATYYCQHSWEIPYTFGGGTKLEIK

SEQ ID NO: 967 - protein, 107 aa, Artificial Sequence
  Synthetic polymer
DIQMTQSPSSLSASVGDRVTITCKASQSVSNDVAWYQQKPGKAPKLLIYYAANRYTGVPDRFSGSGYGTDFTFTISSLQPEDIATYFCQQDYTSPYTFGQGTKLEIK

SEQ ID NO: 968 - protein, 111 aa, Artificial Sequence
  Synthetic polymer
DIVLTQSPASLAVSPGQRATITCRASQSVSTSSSSFMHWYQQKPGQPPKLLIKYASNLESGVPARFSGSGSGTDFTLTINPVEANDTANYYCQHSWEIPYTFGQGTKLEIK

SEQ ID NO: 969 - protein, 117 aa, Artificial Sequence
  Synthetic polymer
EVQLVQSGAEVKKPGESLRISCKGSGYTFTTYWMHWVRQATGQGLEWMGNIYPGTGGSNFDEKFKNRVTITADKSTSTAYMELSSLRSEDTAVYYCTRWTTGTGAYWGQGTTVTVSS

SEQ ID NO: 970 - protein, 117 aa, Artificial Sequence
  Synthetic polymer
EVQLVQSGAEVKKPGESLRISCKGSGYTFTTYWMHWIRQSPSRGLEWLGNIYPGTGGSNFDEKFKNRFTISRDNSKNTLYLQMNSLRAEDTAVYYCTRWTTGTGAYWGQGTTVTVSS

SEQ ID NO: 971 - protein, 117 aa, Artificial Sequence
  Synthetic polymer
QVQLVQSGAEVKKPGASVKVSCKASGYTFTTYWMHWIRQSPSRGLEWLGNIYPGTGGSNFDEKFKNRFTISRDNSKNTLYLQMNSLRAEDTAVYYCTRWTTGTGAYWGQGTTVTVSS

SEQ ID NO: 972 - protein, 117 aa, Artificial Sequence
  Synthetic polymer
EVQLVQSGAEVKKPGESLRISCKGSGYTFTTYWMHWVRQAPGQGLEWMGNIYPGTGGSNFDEKFKNRFTISRDNSKNTLYLQMNSLRAEDTAVYYCTRWTTGTGAYWGQGTTVTVSS

SEQ ID NO: 973 - protein, 113 aa, Artificial Sequence
  Synthetic polymer
EIVLTQSPATLSLSPGERATLSCKSSQSLLDSGNQKNFLTWYQQKPGQAPRLLIYWASTRESGVPSRFSGSGSGTEFTLTISSLQPDDFATYYCQNDYSYPYTFGQGTKVEIK

SEQ ID NO: 974 - protein, 113 aa, Artificial Sequence
  Synthetic polymer
DIQMTQSPSSLSASVGDRVTITCKSSQSLLDSGNQKNFLTWYQQKPGQAPRLLIYWASTRESGIPPRFSGSGYGTDFTLTINNIESEDAAYYFCQNDYSYPYTFGQGTKVEIK

SEQ ID NO: 975 - protein, 113 aa, Artificial Sequence
  Synthetic polymer
EIVLTQSPATLSLSPGERATLSCKSSQSLLDSGNQKNFLTWYQQKPGKAPKLLIYWASTRESGVPSRFSGSGSGTDFTFTISSLQPEDIATYYCQNDYSYPYTFGQGTKVEIK

SEQ ID NO: 976 - protein, 113 aa, Artificial Sequence
  Synthetic polymer
DIVMTQTPLSLPVTPGEPASISCKSSQSLLDSGNQKNFLTWYQQKPGQAPRLLIYWASTRESGVPSRFSGSGSGTDFTFTISSLEAEDAATYYCQNDYSYPYTFGQGTKVEIK

SEQ ID NO: 977 - protein, 113 aa, Artificial Sequence
  Synthetic polymer
EIVLTQSPATLSLSPGERATLSCKSSQSLLDSGNQKNFLTWYQQKPGKAPKLLIYWASTRESGVPSRFSGSGSGTDFTFTISSLEAEDAATYYCQNDYSYPYTFGQGTKVEIK

SEQ ID NO: 978 - protein, 113 aa, Artificial Sequence
  Synthetic polymer
EIVLTQSPDFQSVTPKEKVTITCKSSQSLLDSGNQKNFLTWYQQKPGQAPRLLIYWASTRESGVPSRFSGSGSGTDFTFTISSLEAEDAATYYCQNDYSYPYTFGQGTKVEIK

SEQ ID NO: 979 - protein, 113 aa, Artificial Sequence
  Synthetic polymer
EIVLTQSPATLSLSPGERATLSCKSSQSLLDSGNQKNFLTWYQQKPGQAPRLLIYWASTRESGVPSRFSGSGSGTDFTFTISSLEAEDAATYYCQNDYSYPYTFGQGTKVEIK

SEQ ID NO: 980 - protein, 113 aa, Artificial Sequence
  Synthetic polymer
DIQMTQSPSSLSASVGDRVTITCKSSQSLLDSGNQKNFLTWYLQKPGQSPQLLIYWASTRESGVPSRFSGSGSGTDFTFTISSLEAEDAATYYCQNDYSYPYTFGQGTKVEIK

SEQ ID NO: 981 - protein, 113 aa, Artificial Sequence
  Synthetic polymer
DVVMTQSPLSLPVTLGQPASISCKSSQSLLDSGNQKNFLTWYQQKPGKAPKLLIYWASTRESGVPSRFSGSGSGTDFTFTISSLEAEDAATYYCQNDYSYPYTFGQGTKVEIK

SEQ ID NO: 982 - protein, 118 aa, Artificial Sequence
  Synthetic polymer
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSA

SEQ ID NO: 983 - protein, 108 aa, Artificial Sequence
  Synthetic polymer
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKR

SEQ ID NO: 984 - protein, 126 aa, Artificial Sequence
  Synthetic polymer
EVQLVESGGGLVQPGGSLRLSCAASGFTLDYYAIGWFRQAPGKEREWASSISSSDGSTYYADSVKGRFTISRDNAKNTVFLQMNSLKPEDTAVYSCAASQAPITIATMMKPFYDYWGQGTQVTVSS

SEQ ID NO: 985 - protein, 123 aa, Artificial Sequence
  Synthetic polymer
EVQLVESGGGLVQPGGSLRLSCAASGFTLDYYAKCWFRQAPGKEREWVSCISSSDGSTYYADSVKGRFTISRDNAKNTVYLQMNSLKPEDTAVYFCAARHGGPLTVEYFFDYWGQGTQVTVSS

SEQ ID NO: 986 - protein, 124 aa, Artificial Sequence
  Synthetic polymer
EVQLVESGGGLVQPGGSLRLSCAASGFTFDYYAIGWFRQAPGKAREGVSCISGGDNSTYYADSVKGRFTISRDNAKNTVYLQMNSLKPEDTAVYYCATGGWKYCSGYDPEYIYWGQGTQVTVSS

SEQ ID NO: 987 - protein, 115 aa, Artificial Sequence
  Synthetic polymer
EVQLVESGGGLVQAGGSLRLSCAASGSTFSQYDVGWYRQAPGKQRELVAFSSSGGRTIYPDSVKGRFTFSRDNTKNTVYLQMTSLKPEDTAVYYCKIDWYLNSYWGQGTQVTVSS

SEQ ID NO: 988 - protein, 114 aa, Artificial Sequence
  Synthetic polymer
EVQLVESGGGLVQAGGSLRLSCAASGVDASNSAMGWYRQAPGKQREWVARITGGGLIAYTDSVKGRFTISRDNAKSTVYLQMNSLEPEDTAVYYCNTINSRDGWGQGTQVTVSS

SEQ ID NO: 989 - protein, 111 aa, Artificial Sequence
  Synthetic polymer
EVQLVESGGGLVQAGGSLTISCAASGITFSDSIVSWYRRARGKQREWVAGISNGGTTKYAESVLGRFTISRDNAKNNVYLQMNGLNPEDTAVYLCKVRQYWGQGTQVTVSS

SEQ ID NO: 990 - protein, 130 aa, Artificial Sequence
  Synthetic polymer
EVQLVESGGGLVQAGGSLRLSCAASESTVLINAMGWYRQAPGKQRELVASISSGGSTNYADSVKGRFTISRDNAKNTVYLQMNSLKPEDTAVYYCNADVYPQDYGLGYVEGKVYYGHDYWGTGTLVTVSS

SEQ ID NO: 991 - protein, 119 aa, Artificial Sequence
  Synthetic polymer
EVQLVESGGGLVQAGGSLRLSCAASGSTFSNYVSNYAMGWGRQAPGTQRELVASISNGDTTNYADSVKGRFTISRDNAKNTVYLQMNSLKPEDTAVYYCFEHQVAGLTWGQGTQVTVSS

SEQ ID NO: 992 - protein, 118 aa, Artificial Sequence
  Synthetic polymer
  misc_feature (27)..(27): Xaa can be any naturally occurring amino acid
  misc_feature (32)..(32): Xaa can be any naturally occurring amino acid
  misc_feature (75)..(75): Xaa can be any naturally occurring amino acid
EVQLVESGGGLVQAGGSLRLSCVASGXALKIXVMGWYRQAPGKQRELVAAITSGGRTNYSDSVKGRFTISGDNAXNTVYLQMNSLKSEDTAVYYCREWNSGYPPVDYWGQGTQVTVSS

SEQ ID NO: 993 - protein, 120 aa, Artificial Sequence
  Synthetic polymer
EVQLVESGGGLVQAGGSLRLSCAASGRTFSSGTMGWFRRAPGKEREFVASIPWSGGRTYYADSVKDRFTISRDNAQNTVFLQMNSLKPEDTAVYYCAFKERSTGWDFASWGQGIQVTVSS

SEQ ID NO: 994 - protein, 127 aa, Artificial Sequence
  Synthetic polymer
EVQLVESGGGLVQTGGSLRLSCAASGFTLDYYGIGWFRQAPGKEREGVSFISGSDGSTYYAESVKGRFTISRDKAKNTVYLQMNSLKPEDTAVYYCAADPWGPPSIATMTSYEYKHWGQGTQVTVSS

SEQ ID NO: 995 - protein, 113 aa, Artificial Sequence
  Synthetic polymer
EVQLVESGGGLVQPGGSLRLSCAASGFTFSTYTMIWLRRAPGKGFEWVSTIDKDGNTNYVDSVKGRFAVSRDNTKNTLYLQMNSLKPEDTAMYYCTKHGSSARGQGTRVTVSS

SEQ ID NO: 996 - protein, 114 aa, Artificial Sequence
  Synthetic polymer
EVQLVESGGGLVEPGGSLRLSCVASGFTFSSYDMSWVRQAPGKGLEWVSTINSGGGITYRGSVKGRFTISRDNAKNTLYLQMNSLKPEDTAVYYCENGGSSYRRGQGTQVTVSS

SEQ ID NO: 997 - protein, 114 aa, Artificial Sequence
  Synthetic polymer
QVQLVQSGAELKKPGASVKMSCKASGYTFTGYTMHWVKQAPGQGLEWIGYINPRSGYTEYNQKFKDRTTLTADKSTSTAYMELSSLRSEDSAVYYCARPWFAYWGQGTLVTVSS

SEQ ID NO: 998 - protein, 114 aa, Artificial Sequence
  Synthetic polymer
QVQLVQSGAEVKKPGASVKMSCKASGYTFTGYTMHWVKQAPGQGLEWIGYINPRSGYTEYNQKFKDRTTLTADKSTSTAYMELSSLRSEDTAVYYCARPWFAYWGQGTLVTVSS

SEQ ID NO: 999 - protein, 114 aa, Artificial Sequence
  Synthetic polymer
QVQLVQSGAEVKKPGASVKMSCKASGYTFTGYTMHWVRQAPGQGLEWIGYINPRSGYTEYNQKFKDRTTLTADKSTSTAYMELSSLRSEDTAVYYCARPWFAYWGQGTLVTVSS

SEQ ID NO: 1000 - protein, 114 aa, Artificial Sequence
  Synthetic polymer
QVQLVQSGAEVKKPGASVKVSCKASGYTFTGYTMHWVRQAPGQGLEWIGYINPRSGYTEYNQKFKDRTTLTADKSTSTAYMELSSLRSEDTAVYYCARPWFAYWGQGTLVTVSS

SEQ ID NO: 1001 - protein, 114 aa, Artificial Sequence
  Synthetic polymer
QVQLVQSGAEVKKPGASVKVSCKASGYTFTGYTMHWVRQAPGQGLEWIGYINPRSGYTEYNQKFKDRTTITADKSTSTAYMELSSLRSEDTAVYYCARPWFAYWGQGTLVTVSS

SEQ ID NO: 1002 - protein, 113 aa, Artificial Sequence
  Synthetic polymer
DIVMTQSPASLTVTPGEKVTITCKSSQSLLNSGNQKNYLTWYQQKPGQPPKLLIYWASTRESGVPDRFTGSGSGTDFTLTISSLQAEDVAVYYCQNDYSYPLTFGQGTKLEIK

SEQ ID NO: 1003 - protein, 113 aa, Artificial Sequence
  Synthetic polymer
DIVMTQSPASLSVTPGEKVTITCKSSQSLLNSGNQKNYLTWYQQKPGQPPKLLIYWASTRESGVPDRFTGSGSGTDFTLTISSLQAEDVAVYYCQNDYSYPLTFGQGTKLEIK

SEQ ID NO: 1004 - protein, 113 aa, Artificial Sequence
  Synthetic polymer
DIVMTQSPAFLSVTPGEKVTITCKSSQSLLNSGNQKNYLTWYQQKPGQPPKLLIYWASTRESGVPDRFTGSGSGTDFTLTISSLQAEDVAVYYCQNDYSYPLTFGQGTKLEIK

SEQ ID NO: 1005 - protein, 113 aa, Artificial Sequence
  Synthetic polymer
DIVMTQSPAFLSVTPGEKVTITCKSSQSLLNSGNQKNYLTWYQQKPGQPPKLLIYWASTRESGVPDRFSGSGSGTDFTLTISSLQAEDVAVYYCQNDYSYPLTFGQGTKLEIK

SEQ ID NO: 1006 - protein, 504 aa, Artificial Sequence
  Synthetic polymer
MEPAGPAPGRLGPLLCLLLAASCAWSGVAGEEELQVIQPDKSVLVAAGETATLRCTATSLIPVGPIQWFRGAGPGRELIYNQKEGHFPRVTTVSDLTKRNNMDFSIRIGNITPADAGTYYCVKFRKGSPDDVEFKSGAGTELSVRAKPSAPVVSGPAARATPQHTVSFTCESHGFSPRDITLKWFKNGNELSDFQTNVDPVGESVSYSIHSTAKVVLTREDVHSQVICEVAHVTLQGDPLRGTANLSETIRVPPTLEVTQQPVRAENQVNVTCQVRKFYPQRLQLTWLENGNVSRTETASTVTENKDGTYNWMSWLLVNVSAHRDDVKLTCQVEHDGQPAVSKSHDLKVSAHPKEQGSNTAAENTGSNERNIYIVVGVVCTLLVALLMAALYLVRIRQKKAQGSTSSTRLHEPEKNAREITQDTNDITYADLNLPKGKKPAPQAAEPNNHTEYASIQTSPQPASEDTLTYADLDMVHLNRTPKQPAPKPEPSFSEYASVQVPRK

SEQ ID NO: 1007 - protein, 474 aa, Artificial Sequence
  Synthetic polymer
EEELQVIQPDKSVLVAAGETATLRCTATSLIPVGPIQWFRGAGPGRELIYNQKEGHFPRVTTVSDLTKRNNMDFSIRIGNITPADAGTYYCVKFRKGSPDDVEFKSGAGTELSVRAKPSAPVVSGPAARATPQHTVSFTCESHGFSPRDITLKWFKNGNELSDFQTNVDPVGESVSYSIHSTAKVVLTREDVHSQVICEVAHVTLQGDPLRGTANLSETIRVPPTLEVTQQPVRAENQVNVTCQVRKFYPQRLQLTWLENGNVSRTETASTVTENKDGTYNWMSWLLVNVSAHRDDVKLTCQVEHDGQPAVSKSHDLKVSAHPKEQGSNTAAENTGSNERNIYIVVGVVCTLLVALLMAALYLVRIRQKKAQGSTSSTRLHEPEKNAREITQDTNDITYADLNLPKGKKPAPQAAEPNNHTEYASIQTSPQPASEDTLTYADLDMVHLNRTPKQPAPKPEPSFSEYASVQVPRK

SEQ ID NO: 1008 - protein, 508 aa, Artificial Sequence
  Synthetic polymer
MEPAGPAPGRLGPLLCLLLAASCAWSGVAGEEELQVIQPDKSVLVAAGETATLRCTATSLIPVGPIQWFRGAGPGRELIYNQKEGHFPRVTTVSDLTKRNNMDFSIRIGNITPADAGTYYCVKFRKGSPDDVEFKSGAGTELSVRAKPSAPVVSGPAARATPQHTVSFTCESHGFSPRDITLKWFKNGNELSDFQTNVDPVGESVSYSIHSTAKVVLTREDVHSQVICEVAHVTLQGDPLRGTANLSETIRVPPTLEVTQQPVRAENQVNVTCQVRKFYPQRLQLTWLENGNVSRTETASTVTENKDGTYNWMSWLLVNVSAHRDDVKLTCQVEHDGQPAVSKSHDLKVSAHPKEQGSNTAAENTGSNERNIYIVVGVVCTLLVALLMAALYLVRIRQKKAQGSTSSTRLHEPEKNAREITQVQSLDTNDITYADLNLPKGKKPAPQAAEPNNHTEYASIQTSPQPASEDTLTYADLDMVHLNRTPKQPAPKPEPSFSEYASVQVPRK

SEQ ID NO: 1009 - protein, 503 aa, Artificial Sequence
  Synthetic polymer
MEPAGPAPGRLGPLLCLLLAASCAWSGVAGEEELQVIQPDKSVLVAAGETATLRCTATSLIPVGPIQWFRGAGPGRELIYNQKEGHFPRVTTVSDLTKRNNMDFSIRIGNITPADAGTYYCVKFRKGSPDVEFKSGAGTELSVRAKPSAPVVSGPAARATPQHTVSFTCESHGFSPRDITLKWFKNGNELSDFQTNVDPVGESVSYSIHSTAKVVLTREDVHSQVICEVAHVTLQGDPLRGTANLSETIRVPPTLEVTQQPVRAENQVNVTCQVRKFYPQRLQLTWLENGNVSRTETASTVTENKDGTYNWMSWLLVNVSAHRDDVKLTCQVEHDGQPAVSKSHDLKVSAHPKEQGSNTAAENTGSNERNIYIVVGVVCTLLVALLMAALYLVRIRQKKAQGSTSSTRLHEPEKNAREITQDTNDITYADLNLPKGKKPAPQAAEPNNHTEYASIQTSPQPASEDTLTYADLDMVHLNRTPKQPAPKPEPSFSEYASVQVPRK

SEQ ID NO: 1010 - protein, 5 aa, Artificial Sequence
  Synthetic polymer
GGGGS

SEQ ID NO: 1011 - protein, 10 aa, Artificial Sequence
  Synthetic polymer
GGGGSGGGGS

SEQ ID NO: 1012 - protein, 15 aa, Artificial Sequence
  Synthetic polymer
GGGGSGGGGSGGGGS

SEQ ID NO: 1013 - protein, 20 aa, Artificial Sequence
  Synthetic polymer
GGGGSGGGGSGGGGSGGGGS

SEQ ID NO: 1014 - protein, 25 aa, Artificial Sequence
  Synthetic polymer
GGGGSGGGGSGGGGSGGGGSGGGGS

SEQ ID NO: 1015 - protein, 30 aa, Artificial Sequence
  Synthetic polymer
GGGGSGGGGSGGGGSGGGGSGGGGSGGGGS

SEQ ID NO: 1016 - protein, 35 aa, Artificial Sequence
  Synthetic polymer
GGGGSGGGGSGGGGSGGGGSGGGGSGGGGSGGGGS

SEQ ID NO: 1017 - protein, 40 aa, Artificial Sequence
  Synthetic polymer
GGGGSGGGGSGGGGSGGGGSGGGGSGGGGSGGGGSGGGGS

SEQ ID NO: 1018 - protein, 16 aa, Artificial Sequence
  Synthetic polymer
GGSGGSGGGGSGGGGS

SEQ ID NO: 1019 - protein, 8 aa, Artificial Sequence
  Synthetic polymer
GGGGGGGG

SEQ ID NO: 1020 - protein, 6 aa, Artificial Sequence
  Synthetic polymer
GGGGGG

SEQ ID NO: 1021 - protein, 5 aa, Artificial Sequence
  Synthetic polymer
EAAAK

SEQ ID NO: 1022 - protein, 10 aa, Artificial Sequence
  Synthetic polymer
EAAAKEAAAK

SEQ ID NO: 1023 - protein, 15 aa, Artificial Sequence
  Synthetic polymer
EAAAKEAAAKEAAAK

SEQ ID NO: 1024 - protein, 12 aa, Artificial Sequence
  Synthetic polymer
AEAAAKEAAAKA

SEQ ID NO: 1025 - protein, 17 aa, Artificial Sequence
  Synthetic polymer
AEAAAKEAAAKEAAAKA

SEQ ID NO: 1026 - protein, 22 aa, Artificial Sequence
  Synthetic polymer
AEAAAKEAAAKEAAAKEAAAKA

SEQ ID NO: 1027 - protein, 27 aa, Artificial Sequence
  Synthetic polymer
AEAAAKEAAAKEAAAKEAAAKEAAAKA

SEQ ID NO: 1028 - protein, 46 aa, Artificial Sequence
  Synthetic polymer
AEAAAKEAAAKEAAAKEAAAKALEAEAAAKEAAAKEAAAKEAAAKA

SEQ ID NO: 1029 - protein, 5 aa, Artificial Sequence
  Synthetic polymer
PAPAP

SEQ ID NO: 1030 - protein, 18 aa, Artificial Sequence
  Synthetic polymer
KESGSVSSEQLAQFRSLD

SEQ ID NO: 1031 - protein, 14 aa, Artificial Sequence
  Synthetic polymer
EGKSSGSGSESKST

SEQ ID NO: 1032 - protein, 12 aa, Artificial Sequence
  Synthetic polymer
GSAGSAAGSGEF

SEQ ID NO: 1033 - protein, 3 aa, Artificial Sequence
  Synthetic polymer
GGS

SEQ ID NO: 1034 - protein, 6 aa, Artificial Sequence
  Synthetic polymer
GGSGGS

SEQ ID NO: 1035 - protein, 9 aa, Artificial Sequence
  Synthetic polymer
GGSGGSGGS

SEQ ID NO: 1036 - protein, 12 aa, Artificial Sequence
  Synthetic polymer
GGSGGSGGSGGS

SEQ ID NO: 1037 - protein, 15 aa, Artificial Sequence
  Synthetic polymer
GGSGGSGGSGGSGGS

SEQ ID NO: 1038 - protein, 18 aa, Artificial Sequence
  Synthetic polymer
GGSGGSGGSGGSGGSGGS

SEQ ID NO: 1039 - protein, 21 aa, Artificial Sequence
  Synthetic polymer
GGSGGSGGSGGSGGSGGSGGS

SEQ ID NO: 1040 - protein, 24 aa, Artificial Sequence
  Synthetic polymer
GGSGGSGGSGGSGGSGGSGGSGGS

SEQ ID NO: 1041 - protein, 27 aa, Artificial Sequence
  Synthetic polymer
GGSGGSGGSGGSGGSGGSGGSGGSGGS

SEQ ID NO: 1042 - protein, 30 aa, Artificial Sequence
  Synthetic polymer
GGSGGSGGSGGSGGSGGSGGSGGSGGSGGS

SEQ ID NO: 1043 - protein, 33 aa, Artificial Sequence
  Synthetic polymer
GGSGGSGGSGGSGGSGGSGGSGGSGGSGGSGGS

SEQ ID NO: 1044 - protein, 36 aa, Artificial Sequence
  Synthetic polymer
GGSGGSGGSGGSGGSGGSGGSGGSGGSGGSGGSGGS

SEQ ID NO: 1045 - protein, 39 aa, Artificial Sequence
  Synthetic polymer
GGSGGSGGSGGSGGSGGSGGSGGSGGSGGSGGSGGSGGS

SEQ ID NO: 1046 - protein, 42 aa, Artificial Sequence
  Synthetic polymer
GGSGGSGGSGGSGGSGGSGGSGGSGGSGGSGGSGGSGGSGGS

SEQ ID NO: 1047 - protein, 45 aa, Artificial Sequence
  Synthetic polymer
GGSGGSGGSGGSGGSGGSGGSGGSGGSGGSGGSGGSGGSGGSGGS

SEQ ID NO: 1048 - protein, 48 aa, Artificial Sequence
  Synthetic polymer
GGSGGSGGSGGSGGSGGSGGSGGSGGSGGSGGSGGSGGSGGSGGSGGS

SEQ ID NO: 1049 - protein, 51 aa, Artificial Sequence
  Synthetic polymer
GGSGGSGGSGGSGGSGGSGGSGGSGGSGGSGGSGGSGGSGGSGGSGGSGGS

SEQ ID NO: 1050 - protein, 54 aa, Artificial Sequence
  Synthetic polymer
GGSGGSGGSGGSGGSGGSGGSGGSGGSGGSGGSGGSGGSGGSGGSGGSGGSGGS

SEQ ID NO: 1051 - protein, 57 aa, Artificial Sequence
  Synthetic polymer
GGSGGSGGSGGSGGSGGSGGSGGSGGSGGSGGSGGSGGSGGSGGSGGSGGSGGSGGS

SEQ ID NO: 1052 - protein, 60 aa, Artificial Sequence
  Synthetic polymer
GGSGGSGGSGGSGGSGGSGGSGGSGGSGGSGGSGGSGGSGGSGGSGGSGGSGGSGGSGGS

SEQ ID NO: 1053 - protein, 45 aa, Artificial Sequence
  Synthetic polymer
GGGGSGGGGSGGGGSGGGGSGGGGSGGGGSGGGGSGGGGSGGGGS

SEQ ID NO: 1054 - protein, 50 aa, Artificial Sequence
  Synthetic polymer
GGGGSGGGGSGGGGSGGGGSGGGGSGGGGSGGGGSGGGGSGGGGSGGGGS

SEQ ID NO: 1055 - protein, 55 aa, Artificial Sequence
  Synthetic polymer
GGGGSGGGGSGGGGSGGGGSGGGGSGGGGSGGGGSGGGGSGGGGSGGGGSGGGGS

SEQ ID NO: 1056 - protein, 60 aa, Artificial Sequence
  Synthetic polymer
GGGGSGGGGSGGGGSGGGGSGGGGSGGGGSGGGGSGGGGSGGGGSGGGGSGGGGSGGGGS

SEQ ID NO: 1057 - protein, 65 aa, Artificial Sequence
  Synthetic polymer
GGGGSGGGGSGGGGSGGGGSGGGGSGGGGSGGGGSGGGGSGGGGSGGGGSGGGGSGGGGSGGGGS

SEQ ID NO: 1058 - protein, 70 aa, Artificial Sequence
  Synthetic polymer
GGGGSGGGGSGGGGSGGGGSGGGGSGGGGSGGGGSGGGGSGGGGSGGGGSGGGGSGGGGSGGGGSGGGGS

SEQ ID NO: 1059 - protein, 75 aa, Artificial Sequence
  Synthetic polymer
GGGGSGGGGSGGGGSGGGGSGGGGSGGGGSGGGGSGGGGSGGGGSGGGGSGGGGSGGGGSGGGGSGGGGSGGGGS

SEQ ID NO: 1060 - protein, 80 aa, Artificial Sequence
  Synthetic polymer
GGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 1061 - protein, 85 aa, Artificial Sequence
  Synthetic polymer
GGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 1062 - protein, 90 aa, Artificial Sequence
  Synthetic polymer
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 1063 - protein, 95 aa, Artificial Sequence
  Synthetic polymer
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 1064 - protein, 100 aa, Artificial Sequence
  Synthetic polymer
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 1065 - protein, 5 aa, Artificial Sequence
  Synthetic polymer
GGGSE

SEQ ID NO: 1066 - protein, 5 aa, Artificial Sequence
  Synthetic polymer
GSESG

SEQ ID NO: 1067 - protein, 5 aa, Artificial Sequence
  Synthetic polymer
GSEGS

SEQ ID NO: 1068 - protein, 35 aa, Artificial Sequence
  Synthetic polymer
GEGGSGEGSSGEGSSSEGGGSEGGGSEGGGSEGGS

SEQ ID NO: 1069 - protein, 4 aa, Artificial Sequence
  Synthetic polymer
CPPC

SEQ ID NO: 1070 - DNA, 20 bp, Artificial Sequence
  Synthetic polymer
ttatgcttccggctcgtatg

SEQ ID NO: 1071 - DNA, 29 bp, Artificial Sequence
  Synthetic polymer
  misc_feature (24)..(24): R is A or G
gatgtgcagctgcaggagtctggrggagg

SEQ ID NO: 1072 - DNA, 33 bp, Artificial Sequence
  Synthetic polymer
ctagtgcggccgctgaggagacggtgacctggg

SEQ ID NO: 1073 - DNA, 22 bp, Artificial Sequence
  Synthetic polymer
tcacacaggaaacagctatgac

SEQ ID NO: 1074 - DNA, 24 bp, Artificial Sequence
  Synthetic polymer
cgccagggttttcccagtcacgac

SEQ ID NO: 1075 - DNA, 423 bp, Artificial Sequence
  Synthetic polymer
caggtgcagctgcaggagtctggaggaggcttggtgcagcctggggggtctctgagactctcctgtttagcctctagaagcttctccagcttcaatgccatgggctggtaccgccaggccccagggaaggagcgcgagttggtcgcagctattactaatggtgggaggatagcctatggaatcgccgtgaacggccgattcaccatctccagagacaacgccaagaacacagtgtatctgcaaatgaacagcctgaaacctgaggacacggccgtctattactgtaatgccaagcctactcctgtctacgggtcgacggttggggactactggggccaggggacccaggtcaccgtctcctcagcggccgcatacccgtacgacgttccggactacggttcccaccaccatcaccatcactag

SEQ ID NO: 1076 - DNA, 423 bp, Artificial Sequence
  Synthetic polymer
caggtgcagctgcaggagtctgggggaggcttggtgcagcctggggggtctctgagactctcctgtgcagcctctagaagcttcttcagcttcaatgccatgggctggtaccgccaggctccggggaagcagcgcgagttggtcgcagctattactaatggtggtaggatagcctatggaacctccgtgatgggccgattcaccatctccagagacaacgccaagaacacggtgtatctgcaaatggacagcctgaaacctgaggacacggccgtctattactgtaatgccaagcctgctcctgtctacgggtcgacggttggggactactggggccaggggacccaggtcaccgtctcctcagcggccgcatacccgtacgacgttccggactacggttcccaccaccatcaccatcactag

SEQ ID NO: 1077 - DNA, 423 bp, Artificial Sequence
  Synthetic polymer
caggtgcagctgcaggagtctgggggaggattggtgcagcctggggggtctctgagactctcctgtgcagtctctagaaacttcttcagtatcaatgccatgggctggtaccgccaggctccagggaagcagcgcgagttggtcgcagctattactaatggtggtaggatagcctatggaacctccgtgatgggccgattcaccatctccagagacgacgccaagaacacggtcgatctgcaaatgaacagcctgagacctgaggacacggccgtctattactgtaatgccaaggctattcctgtctatgggtcgacggttgaggactactggggccaggggacccaagtcaccgtctcctcagcggccgcatacccgtacgacgttccggactacggttcccaccaccatcaccatcactag

SEQ ID NO: 1078 - DNA, 423 bp, Artificial Sequence
  Synthetic polymer
caggtgcagctgcaggagtctgggggaggcttggtgcagtctggggggtctctgagactctcctgtgcagcctctggaagcgtgttcagtatcaatgcctggggctggtaccgccaggctccagggaagcagcgcgagttggtcgcagctattactaatcagggaaggatagcctatgcaccctccgtgaacggccgattcaccatctccagagacagcgccaagaacacggtgtatctgcaaatgaacagcctgaaacctgaggacacggccgtctattattgtaatgccaagcctactcctgtctacgggtcgacggttggggactactggggccaggggacccaggtcaccgtctcctcagcggccgcatacccgtacgacgttccggactacggttcccaccaccatcaccatcactag

SEQ ID NO: 1079 - DNA, 423 bp, Artificial Sequence
  Synthetic polymer
caggtgcagctgcaggagtctgggggaggcttggtgcaggctggggggtctctgacactctcctgtgcagcctctggaagcttctccagtatcaatgccatgggctattaccgccaggctccagggaagcagcgcgagttggtcgcagcaattactaatggtggtaggatagcctattcagactccgcgaagggccgattcaccatctccagagacagcgccaagaacacgatgtatctgcaaatgaacagcctgaaacctgaggacacggacgtctattactgtaatgccaaggctagccctgtctacggctcgacggttgaggactactggggccaggggacccaggtcaccgtctcctcagcggccgcatacccgtacgacgttccggactacggttcccaccaccatcaccatcactag

SEQ ID NO: 1080 - DNA, 423 bp, Artificial Sequence
  Synthetic polymer
caggtgcagctgcaggagtctgggggaggcttggtgcagcctggggggtctctgagactctcctgtacagcctctggaagcttcttcagtatcaacgccatgggctggtaccgccaggctccagggaatcagcgcgagttggtcgcagctattactaatggtggtaggatagcctatacagactccgtgaagggccgattcaccatctccaacgacaacgccaagaacacggtgtatctgcaaatgaacagcctgaaacctgaggacacggacgtctattactgtaatgccaaggctattcctatctacgggtcgacggcagaggactactggggccaggggacccaggtcaccgtctcctcagcggccgcatacccgtacgacgttccggactacggttcccaccaccatcaccatcactag

SEQ ID NO: 1081 - DNA, 399 bp, Artificial Sequence
  Synthetic polymer
caggtgcagctgcaggagtctgggggaggcttggtgcagcctggggggtctctgagactctcctgtgcagcctctggaagcttcttcagtatcaatgccatgggctggtaccgccaggctccagggaagcagcgcgagttggtcgcagctattactaatcagggtaggatagcctatgcagactccgtgaagggccgattcaccatctccagagacaacgccaagaacacggtgtatctgcaaatgaacagcctgaaacctgaggacacagccgtctattactgtggccgcccggggtgggactactggggccaggggacccaggtcaccgtctcctcagcggccgcatacccgtacgacgttccggactacggttcccaccaccatcaccatcactag

SEQ ID NO: 1082 - DNA, 405 bp, Artificial Sequence
  Synthetic polymer
caggtgcagctgcaggagtctgggggaggattggtgcaggctggggcctctctgagactctcctgtgcagcctctggaagcatcttcagtatcaatgccatgggctggtaccgccaggctccagggaagcagcgcgagttggtcgcagctataactaatcaaggtagaacaacctatgcagactccgtgaagggccgattcaccatctccagagacaacgccaagaacacggtgtatctgcaaatggacagcctggaacctgaggacacggccatctattactgcaaagggttttccccgacgggcgactactggggccaggggacccaggtcaccgtctcctcagcggccgcatacccgtacgacgttccggactacggttcccaccaccatcaccatcactag

SEQ ID NO: 1083 - DNA, 405 bp, Artificial Sequence
  Synthetic polymer
caggtgcagctgcaggagtctgggggaggcttggtgcaggctggggggtctctgagactctcctgtgcagcctctggaagcatcttcagtatcaattccatgggctggtaccgccaggctccagggaagcagcgcgagttggtcgcagctattactaatggaggtagaacaacctatgcagactccgtgaagggccgattcaccatctccagagacaacgccaagaacacggtgtatctgcaaatggacagcctgaaacctgaggacacggccgtctattactgcaaagggttttcccttacggatgactactggggccaggggacccaggtcaccgtctcctcagcggccgcatacccgtacgacgttccggactacggttcccaccaccatcaccatcactag

SEQ ID NO: 1084 - DNA, 423 bp, Artificial Sequence
  Synthetic polymer
caggtgcagctgcaggagtctgggggaggcttggtgcagcctggggggtctctgagactctcctgtgcagcctctggaagcatcttcagtatcaatgccatgggctggtaccgccaggctccagggaagcagcgcgagttggtcgcagctattactaatcaaggtagattaacctatgcagactccgtgaagggccgattcaccatctccagagacaacgccaagaacacggtgtttctgcaaatggacagcctgaaacctgaggacacggccgtctattactgtaatgcaaagtggtatgatccgctagtgattgagtactatgacaactggggccaggggacccaggtcaccgtctcctcagcggccgcatacccgtacgacgttccggactacggttcccaccaccatcaccatcactag

SEQ ID NO: 1085 - DNA, 423 bp, Artificial Sequence
  Synthetic polymer
caggtgcagctgcaggagtctgggggaggcttggtgcagcctggggggtctctgagactctcctgtgcagcctctggaaggttcttcagagtcaatgccatgggctggtaccgccaggttccagggaagcagcgcgagttggtcgcagctattactaatggtggacaaatagcctatgcagactccgtgaagggccgattcaccatctccagagacagcgccaagaacacggtgtatctgcaaatgaacagcctgaagtctgaggacacggacgtctattactgtaatgccaaggctgctgctactcacctgtcgacggttgcggactactggggccaggggacccaggtcaccgtctcctcagcggccgcatacccgtacgacgttccggactacggttcccaccaccatcaccatcactag

SEQ ID NO: 1086 - DNA, 423 bp, Artificial Sequence
  Synthetic polymer
caggtgcagctgcaggagtctgggggaggcttggtgcagcctggggggtctctgagactctcctgtgcagcctctggaaggttcttcagagtcaatgccatgggctggtaccgccaggctccagggaagcagcgcgagttggtcgcagctattactaatggtggacaaatagtctatgcagactccgtgaagggccgattcaccatctccagagacagcgccaagaacacggtgtatctgcaaatgaacagcctgaagtctgaggacacggccgtctattactgtaatgccaaggctgctgctagctacgtgtcgacggttgcggactactggggccaggggacccaggtcaccgtctcctcagcggccgcatacccgtacgacgttccggactacggttcccaccaccatcaccatcactag

SEQ ID NO: 1087 - DNA, 408 bp, Artificial Sequence
  Synthetic polymer
caggtgcagctgcaggagtctgggggaggattggtgcagcctggggggtctccgagactctcctgtgcagcctctggaaggttcttcagagtcaatgccatgggctggtaccgccaggctccagggaagcagcgcgagttggtcgcagctattactaatggtggacaaacagcctatgcagactccgtgaagggccgattcaccatctccagagacagcgccaagaacacggtgtatctgcaaatgaacagcctgaagtctgaggacacggccgtctattactgtaaggttttcgcggcggacggcatggagtactggggtaaagggacccaggtcaccgtctcctcagcggccgcatacccgtacgacgttccggactacggttcccaccaccatcaccatcactag

SEQ ID NO: 1088 - DNA, 405 bp, Artificial Sequence
  Synthetic polymer
caggtgcagctgcaggagtctgggggaggattggtgcaggctgggggctctctgagactctcctgtgcagcctctggacgcaccttgagtagctataccataggctggtaccgccaggctccggggaagcagcgcgagttggtcgcagctattactaatcaaggtaggagaacgtatgcagactccgtgaagggccgattcaccatctccagagacaacgccaagaacacggtgtatctgcaaatggacagcctgaaatctgaggacacggccgtctattactgcaaagggttttcccctacggatgacttctggggccaggggacccaggtcaccgtctcctcagcggccgcatacccgtacgacgttccggactacggttcccaccaccatcaccatcactag

SEQ ID NO: 1089 - DNA, 408 bp, Artificial Sequence
  Synthetic polymer
caggtgcagctgcaggagtctgggggaggcttggtgcaacctggggggtctctgagactctcctgtgcagcctctggaagcatcagcagtatcaatgccatgggctggtaccgccaggctccagggaatcagcgcgagttggtcgcagctattactaatcaaggtagggtaacgtatgcagactccgtgaagggccgattcaccatttccagagacggcgccaagaacacggtgtatctgcaaatgaacagcctgaaacctgaggacacggccgtctattattgtaaggttttcgcggcgtctggcatggagtactggggtaaagggacccaggtcaccgtctcctcagcggccgcatacccgtacgacgttccggactacggttcccaccaccatcaccatcactag

SEQ ID NO: 1090 - DNA, 408 bp, Artificial Sequence
  Synthetic polymer
caggtgcagctgcaggagtctgggggaggcttggtgcagcctggggggtctctgagactctcctgtgcagcctctggaagcatcagcagtatcaatgccatgggctggtaccgccaggctccagggaagcagcgcgagttggtcgcagccattactggtcaaggcaggacaacgtatgcagactccgtgaagggccgattcaccatttccagagacggcgccaagaacacggtgtatctgcaaatgaacagtctgaaacctgaggacacggccgtctattattgtaaagttttcgcggcggacggcatggagtactggggtaaagggacccaggtcaccgtctcctcagcggccgcatacccgtacgacgttccggactacggttcccaccaccatcaccatcactag

SEQ ID NO: 1091 - DNA, 405 bp, Artificial Sequence
  Synthetic polymer
caggtgcagctgcaggagtctgggggaggcttggtgcagcctggggggtctctgagactctcctgtgcagcctctggaagcatcttcagtatcgcagccatgggctggtaccgccaggctccagggaagcagcgcgagttggtcgcggctattactagcggtggtaggagagcctatgcagactccgtgaagggccgattcaccatctccagagacaacgacgagaacacggtggccctgcaaatgaacagcctgaaacctgaggacacggacgtctattactgtaatgcgaaggcagatcacaacgactactggggccagggaacccagatcaccgtctcctcagcggccgcatacccgtacgacgttccggactacggttcccaccaccatcaccatcactag

SEQ ID NO: 1092 - DNA, 402 bp, Artificial Sequence
  Synthetic polymer
caggtgcagctgcaggagtctggaggaggcttggtgcagcctggggagtctctgagactctcctgtgcagcctctggaatcatcttcagtatcaatgccatgggttggtaccgccaggctccagggaagcagcgcgagttggtcgcagctattactaattagggtaggacaacgtatgcagactccgtgaagggccgattcaccatctccagagacaacgccaagaacacggtgacactgcaaatgaacagcctgaaacctgaggacacggccgtctattattgcaatgcatttggttccggcgggggagtgggccaggggacccaggtcaccgtctcctcagcggccgcatacccgtacgacgttccggactacggttcccaccaccatcaccatcactag

SEQ ID NO: 1093 - DNA, 411 bp, Artificial Sequence
  Synthetic polymer
caggtgcagctgcaggagtctgggggaggcttggtgcagcctggggggtctctgagactctcctgtgcagcctctggaagcatcgtcagtatcaattccatgggctggtaccgccaggctccagggaagcagcgcgagttggtcgcggctattactgatcaaggacgcaccacctatgcagactccgtgaagggccgattcaccatctccagagacgacgccaagaacaagaacacggtgtatctgcaaatgaacagcctgaaagctgaggacacggccgtctatgcctgtaaggcctttggacggttcgatgactactggggccaggggacccaggtcaccgtctcctcagcggccgcatacccgtacgacgttccggactacggttcccaccaccatcaccatcactag

SEQ ID NO: 1094 - DNA, 405 bp, Artificial Sequence
  Synthetic polymer
caggtgcagctgcaggagtctggaggaggcttggtgcagcctggggggtctctgagactctcctgtgcagcctctggaagaatctccagtatcaatagcatgggctggtaccgccaggctccaggaaaccagcgcgagttggtcgcagctattactaatggtggcgccaaaacctatgcagactccgtgaagggccgattcaccatctccacagacaacgccgggaacacggtgtatctgcaaatggacagcctgagacctgaggacacggccgtctattactgtaaagcctttacgaggagggatgactactggggccagggaacccagatcaccgtctcctcagcggccgcatacccgtacgacgttccggactacggttcccaccaccatcaccatcactag

SEQ ID NO: 1095 - DNA, 405 bp, Artificial Sequence
  Synthetic polymer
caggtgcagctgcaggagtctggaggaggcttggtgcagcctggggagtctctgagactctcctgtgcagcctctggaagcatcttcagtatcaatgccatgggctggtaccgccaggctccaggaaaacagcgcgagttggtcgcagcaattactgatggtggtgccaaaacctatgcagactccgtgaagggccgattcaccatctccacagacaacgccgggaacacggtgtatctgcaaatggacagcctgagacctgaggacacggccgtctattactgtaaagcctttacgaggggaaatgactactggggccaggggacccaggtcaccgtctcctcagcggccgcatacccgtacgacgttccggactacggttcccaccaccatcaccatcactag

SEQ ID NO: 1096 - DNA, 405 bp, Artificial Sequence
  Synthetic polymer
caggtgcagctgcaggagtctggaggaggcttggtgcagcctggggggtctctgagactctcctgtgcagcctctggaagaatctccagtatcaatagcatgggctggtaccgccaggctccaggaaagcagcgcgaattggtcgcagccattactaatggtggtgccaaaacgtatgcagactccgtgaagggccgattcaccatctccagagacggcgccgggaacacggtgtatctgcaaatggacaacctgagacctgaggacacggccgtctattactgtaaagcctttacgaggacatatgactactggggccaggggacccaggtcaccgtctcctcagcggccgcatacccgtacgacgttccggactacggttcccaccaccatcaccatcactag

SEQ ID NO: 1097 - DNA, 405 bp, Artificial Sequence
  Synthetic polymer
caggtgcagctgcaggagtctgggggaggcttggtgcagcctggggggtctctgagactctcctgtgcagcctctggaagagtcttcagtatcaatgccatgggctggtaccgccaggctccaggaaagcagcgcgagctggtcgcagcaattactaatcaaggtgccacaacctatgcagactccgtgaagggccgattcaccatctccagagacaccgccgggaacacggtgtatctgcaaatgaacagcctgagacctgaggacacggccgtccattactgtaaagcctttacgaggactgatgactactggggccaggggacccaggtcaccgtctcctcagcggccgcatacccgtacgacgttccggactacggttcccaccaccatcaccatcactag

SEQ ID NO: 1098 - DNA, 405 bp, Artificial Sequence
  Synthetic polymer
caggtgcagctgcaggagtctgggggaggcttggtgcagcctggggggtctctgagactctcctgtgcagcctctggaagaatcttcagtgtcaatgccatgggttggtaccgccaggctccaggaaagcagcgcgagttggtcgcagctattactaatcaaggtgccccaacctatgcagactccgtgaagggccgattcaccatctccagagacaacgccgggaacacggtgtatctgcaaatgaacagcctgagacctgaggacacggccgtctattactgtaaagcctttacgaggggagatgactattggggccaggggacccaggtcaccgtctcctcagcggccgcatacccgtacgacgttccggactacggttcccaccaccatcaccatcactag

SEQ ID NO: 1099 - DNA, 405 bp, Artificial Sequence
  Synthetic polymer
caggtgcagctgcaggagtctgggggaggcttggtgcagcctggggggtctctgagactctcctgtgcagcctctggaagaatcttcgatatcaatgccatgggctggtaccgccaggctccaggaaagcagcgcgagttggtcgcagctattactaatggtggtcagacaacgtatgcagactccgtgaagggccgattcaccatctccagagacaacgccgggaacacggtgtatctgcaaatgaacagtttgagacctgaggacacggccgtctattactgtaaagcctttacgaggagcgatgactactggggccaggggacccaggtcaccgtctcctcagcggccgcatacccgtacgacgttccggactacggttcccaccaccatcaccatcactag

SEQ ID NO: 1100 - DNA, 405 bp, Artificial Sequence
  Synthetic polymer
caggtgcagctgcaggagtctggaggaggcttggtgcagcctggggggtctctgagactctcctgtgcagcctctggaagaatcggcagtatcaattctatgggctggtaccgccaggctccaggaaagcagcgcgaaatggtcgcagctattactaatggtggtgccacagtctatgcagactccgtgaagggccgattcaccatctccagagacaacgccgggaacacggtagatctgcacatgaacagcctgagacctgaggactcggccgtctattactgtaaagcctttacgaggggagatgactactggggccaggggacccaggtcaccgtctcctcagcggccgcatacccgtacgacgttccggactacggttcccaccaccatcaccatcactag

SEQ ID NO: 1101 - DNA, 408 bp, Artificial Sequence
  Synthetic polymer
caggtgcagctgcaggagtctggaggaggcttggtgcagcctggggggtctctgagactctcctgtgcagcctctggaagaatcggcagtatcaattctatgggctggtaccgccaggctccaggaaagcagcgcgaaatggtcgcagctattactaatggtggtgccacagtctatgcagactccgtgaagggccgattcaccatctccagagacaacgccgggaacacggtagatctgcacatgaacagcctgagacctgaggactcggccgtctattactgtacaatatgggcagcggattatcaacagtattggggccaggggacccaggtcaccgtctcctcagcggccgcatacccgtacgacgttccggactacggttcccaccaccatcaccatcactag

SEQ ID NO: 1102 - DNA, 405 bp, Artificial Sequence
  Synthetic polymer
caggtgcagctgcaggagtctggaggaggcttggtgcagcctggggggtctctgagactctcctgtgcagcctctggaggaatttccagtatcaattccatgggctggtaccgccaggctccaggaaatcagcgcgaattggtcgcggctattactaatggtggtaggacagtgtatggagactccgtgaagggccgattcaccatctccagagacagcgccgggaacacggtgcatctgcaaatggacagcctgagacctgaggacactggcgtgtattactgtaaagcctttacgaggggagatgactactggggccaggggacccaggtcaccgtctcctcagcggccgcatacccgtacgacgttccggactacggttcccaccaccatcaccatcactag

SEQ ID NO: 1103 - DNA, 408 bp, Artificial Sequence
  Synthetic polymer
caggtgcagctgcaggagtctggaggaggcttggtgcagactggggggtctctgagactctcctgtgcagcctctggaagcatcttcagtttcaatgccatgggctggtaccgtcaggctccagggaagcagcgcgagttggtcgcggctattactgatggtggcagattaacctatgcagactccgcgaagggccgattcaccatctccagagagaacacccggaacacggtgcatctgcaaatgagtagcctgaaagccgaggacacagccgactattactgtacaatatggaccagggatcggcaacagtattggggccaggggacccaggtcaccgtctcctcagcggccgcatacccgtacgacgttccggactacggttcccaccaccatcaccatcactag

SEQ ID NO: 1104 - DNA, 408 bp, Artificial Sequence
  Synthetic polymer
caggtgcagctgcaggagtctgggggaggcttggtgcagcctggggggtctctgaaactctcctgtgcagcctctggaagcatcttcagtttcaatgccatgggctggtaccgtcaggctccagggaagcagcgcgagttggtcgcggctattactgatggtggcagattaacctatgcagactccgcgaagaaccgattcaccatctccagagagaacacccgcaacacggtgcatctgcaaatgagtagcctgaaagccgaggacacagccgtctattactgtacaatatggaccaaagatcggcaacagtattggggccaggggacccaggtcaccgtctcctcagcggccgcatacccgtacgacgttccggactacggttcccaccaccatcaccatcactag

SEQ ID NO: 1105 - DNA, 408 bp, Artificial Sequence
  Synthetic polymer
caggtgcagctgcaggagtctggaggaggcttggtggagactggggggtctctgagactctcctgtgcagcctctggaagcatcttcagtatcaatgccatgggctggtaccgccaggctccagggaagcagcgcgagttggtcgcggctattactgatcaaggtagattagcctacgcagactccgcgaagggccggttcaccatctccagagagaacgcccggaacacgctgcatctgcaaatgagtagcctgaaagccgaggacacagccgtctattactgtacaatatgggacagggatcggcaacagtattggggccaggggacccaggtcaccgtctcctcagcggccgcatacccgtacgacgttccggactacggttcccaccaccatcaccatcactag

SEQ ID NO: 1106 - DNA, 408 bp, Artificial Sequence
  Synthetic polymer
caggtgcagctgcaggagtctgggggaggcttggtgcaggctggggaatctctgagactctcctgtgcagcctctgtaagcatcttccgcagttatttcatgggctggtaccgtcaggctccagggaagcagcgagagttggtcgcggctattactgatggtggcagattggcctatgcagactccgcgaagggccgattcaccatctccagagaagacacccggaacacggtgcatctgcaaatgagtagcctgaaagccgaggacacagccgtctattactgtacaatatggaccacggatcggcaacagtattggggccaggggacccaggtcaccgtctcctcagcggccgcatacccgtacgacgttccggactacggttcccaccaccatcaccatcactag

SEQ ID NO: 1107 - DNA, 408 bp, Artificial Sequence
  Synthetic polymer
caggtgcagctgcaggagtctgggggaggcttggtgcagcctggggggtctctgagactctcctgtgcagcctctggaaggttcttcagagtcaatgccatgggctggtaccgccaggctccagggaagcagcgcgagttggtcgcagctattactaatggtggacaaacagcctatgcagactccgtgaagggccgattcaccatctccaaggagagcgcccggaacacggtgcatctgcaaatgagtagcctgaaacccgaagacacagccgtctattactgtacaatatgggcagcggattatcaacagtattggggccaggggacccaggtcaccgtctcctcagcggccgcatacccgtacgacgttccggactacggttcccaccaccatcaccatcactag

SEQ ID NO: 1108 - DNA, 408 bp, Artificial Sequence
  Synthetic polymer
caggtgcagctgcaggagtctgggggaggcttggtgcagactggggggtctctgagactctcctgtgcagcctctggaagcatcttcaatatcaattccatgggctggtaccgccaggctccagggaagcagcgcgaattggtcgcggctattactgttggtggcagattagcctatgcagactccgcgaagggccgattcaccatctccaaggagagcgcccggaacacggtgcatctgcaaatgagtagcctgaaacccgaagacacagccgtctattactgtacaatatgggcagcggattatcaacagtattggggccaggggacccaggtcaccgtctcctcagcggccgcatacccgtacgacgttccggactacggttcccaccaccatcaccatcactag

SEQ ID NO: 1109 - DNA, 408 bp, Artificial Sequence
  Synthetic polymer
caggtgcagctgcaggagtctgggggaggcttggtgcagactggggggtctctgagactctcctgtgcagcctctggaagcatcttcagtatcaactccatgggctggtaccgccaggctccagggaagcagcgcgagttggtcgcggctattactagtcaaggtagatcaacttatgcagactccgcgaagggccgattcaccatctccttagggaacgcccggaacacggtgaatctgcaaatgagtagcctgaaaactgaggacacagccgtctattactgtacaatctgggccagggatcggcaacagtactggggccaggggacccaggtcaccgtctcctcagcggccgcatacccgtacgacgttccggactacggttcccaccaccatcaccatcactag

SEQ ID NO: 1110 - DNA, 411 bp, Artificial Sequence
  Synthetic polymer
caggtgcagctgcaggagtctggaggaggcttggtgcagactggggagtctctgagcctctcctgtgcagtagcctctggaagcatcatcagtatcaattccatgggctggtaccgccaggctccagagaagcagcgcgaattggtcgcggctattactgttgatggcagattagcctatgcagactccgcgaagcaccgattcaccatctccaaagagagcgcccggaacacggtgcatctgcacatgagtagtttgaaacccgaggacacagccgtctattactgtacaatctgggtcagggatgggcaacagtattggggccaggggacccaggtcaccgtctcctcagcggccgcatacccgtacgacgttccggactacggttcccaccaccatcaccatcactag

SEQ ID NO: 1111 - DNA, 408 bp, Artificial Sequence
  Synthetic polymer
caggtgcagctgcaggagtctgggggaggcttggtgcagaccggggggtctctgagactctcctgtgcagcctctgtaagcatcagcagtatcaattccatgggctggtaccgccaggctccagggaaggagcgcgagttggtcgcggcagtcactgttggcggcagatatgcctacgcagactccgcgaagaaccgattcaccatctccagagacgacgcccagaacacggtacatctgcaaatgagtagcctgagagccgaggacacagccgtctattactgtacaatatgggacagggatcggcaacagtattggggctaggggacccaggtcaccgtctcctcagcggccgcatacccgtacgacgttccggactacggttcccaccaccatcaccatcactag

SEQ ID NO: 1112 - DNA, 405 bp, Artificial Sequence
  Synthetic polymer
caggtgcagctgcaggagtctgggggaggcttggtgcgggctggggggtctctgagactctcctgtgcagcctctggaagcatcttcagtatcgatgccatgggctggtaccgcccggctcacggggaacagcgcgagttggtcgcagctattactactggtggtaggacaacatatgtagactccgtgaagggccgattcaccatctccagagacaacgccaagaacacggtgtatctgcaaatgaacagcctgaaacctgaggatacagccgtctatttctgtaaagcattcactagagatgaagactactggggccaggggacccaggtcaccgtctcctcagcggccgcatacccgtacgacgttccggactacggttcccaccaccatcaccatcactag

SEQ ID NO: 1113 - DNA, 405 bp, Artificial Sequence
  Synthetic polymer
caggtgcagctgcaggagtctgggggaggcttggtgcaggctggggggtctctgagactctcctgtgcagcctctggaagcatcttcagtatcaatgccatgggctggtaccgcccggctctaggggagcagcgcgagttggtcgcagctattactactggtggtaggacaacatatgtagactccgtgaagggccgattcagcatctccagagacaacgccaagaacacggtgtatctacaaatgaacagcctgaaacctgaggacacagccgtctacttctgtaaagcattcactagggatgaagacttctggggccaggggacccaggtcaccgtctcctcagcggccgcatacccgtacgacgttccggactacggttcccaccaccatcaccatcactag

SEQ ID NO: 1114 - DNA, 405 bp, Artificial Sequence
  Synthetic polymer
caggtgcagctgcaggagtctgggggaggcttggtgcaggctggggggtctctgagactctcctgtgcagcctctggaagcatcgacagtatcaatgccatgggctggtaccgcccggctctaggggagcagcgcgagttggtcgcagctattactactggtggtaggacggcgtatgtagactccgtgaagggccgattcaccatctccagagacgccgccaagaacacggtgtatctgcaaatgaacagcctgaaacctgaggacacagccgtctattcctgtaaagcatttactagagatacagactactggggccaggggacccaggtcaccgtctcctcagcggccgcatacccgtacgacgttccggactacggttcccaccaccatcaccatcactag

SEQ ID NO: 1115 - DNA, 405 bp, Artificial Sequence
  Synthetic polymer
caggtgcagctgcaggagtctgggggaggcttggtgcaggctggggggtctctgagactctcctgtgcagcctctggaagcataatcggtatcaatagcatgggctactaccgtacggctccagggaagcagcgcgagttggttgcagctattactagtggtggtaggacaacatatgtagactccgtgaagggccgattcaccatctccagagacaacgccaagaacacggtgtatctgcaaatgaacagcctgaaacctgaggacacagccgtctatttctgtaaagcattcactagagatgaagactactggggccaggggacccaggtcaccgtctcctcagcggccgcatacccgtacgacgttccggactacggttcccaccaccatcaccatcactag

SEQ ID NO: 1116 - DNA, 405 bp, Artificial Sequence
  Synthetic polymer
caggtgcagctgcaggagtctgggggaggcttggtgcaggctggggggtctctgagactctcctgtgcagcaactggagacatcagcagtatcaatgccatgggctggcaccgcccggctcgggggaacgagcgcgagttggtcgcagctattactaatggtggtaggaccacatatgtagactccgtgaagggccgattcaccatctccagagacaacgccaagaacacggtgtatctgcaaatgaacagcctgaaacctgaggacacagccgtctatttctgtaaagcatacactagagatgaagactactggggccaggggacccaggtcaccgtctcctcagcggccgcatacccgtacgacgttccggactacggttcccaccaccatcaccatcactag

SEQ ID NO: 1117 - DNA, 405 bp, Artificial Sequence
  Synthetic polymer
caggtgcagctgcaggagtctgggggaggcttggtgcaggctggggggtctctgagactctcctgtgcagcctctggaagcatcctcagtatcaattccatgggctggtaccgcccggctctagggaaccagcgcgagttggtcgcagctattactaacgatggaaggaccacatatgtagactccgtgaagggccgattcaccatctccagagacaacgccaagaacacggtgtatctgcaaatgaacagcctgaaacctgaggacacagccgtctattggtgtaaagcttttactagagataaagactactggggccaggggacccaggtcaccgtctcctcagcggccgcatacccgtacgacgttccggactacggttcccaccaccatcaccatcactag

SEQ ID NO: 1118 - DNA, 408 bp, Artificial Sequence
  Synthetic polymer
caggtgcagctgcaggagtctgggggaggcttggtgcaggctggggaatctctgagactctcctgtgcagcctctggatcgagcgacagtatcaatgccatgggctggtaccgccaggctccagggaagcagcgcgagttggtcgcggcgattactagtggtgggagatcaacctatatagactccgcgaagggccgagcgaccatctccagagacaacgcccggaacacggcgtatttgcaaatgagtagcctgaaagctgaggacacagccgtctattactgtacaatatggaacagggatcggcaacaatactggggccaggggacccaggtcaccgtctcctcagcggccgcatacccgtacgacgttccggactacggttcccaccaccatcaccatcactag

SEQ ID NO: 1119 - DNA, 405 bp, Artificial Sequence
  Synthetic polymer
caggtgcagctgcaggagtctggaggaggcttggtgcaggctggggggtctctgaggctctcctgtgcagcctctggaagcatcaccagtatcaatgccatgggctggtaccgccaggctccagggaagcagcgcgagttggtcgcagctattactagtggtggtagattaagctatgcagactccgtgaagggccgattcaccatctccagagacaacgccgagagcacggtggctctgcaaatgaacagcctgaaacctgaggacacagccgtctatagctgtgcagcctttcaaagcagcggaatagactggggccaggggacccaggtcaccgtctcctcagcggccgcatacccgtacgacgttccggactacggttcccaccaccatcaccatcactag

SEQ ID NO: 1120 - DNA, 405 bp, Artificial Sequence
  Synthetic polymer
caggtgcagctgcaggagtctgggggaggattggtgcaggctggggaatctctgagactctcctgtgtagtctctggacgcaccttcagtatcaatgccatgggctggtaccgccaggctccagggaagcagcgcgagttggtcgcagcgattactaatcaaggtaggctaagctatgtagactccgtgaagggccgattcaccatctccagagacaacgccgcgaacacggtgtatctgcaaatgaacagcctgaaacctgaggacacagccgtctattactgtgcagcctttcaaagcagcggaatagactggggccaggggacccaggtcaccgtctcctcagcggccgcatacccgtacgacgttccggactacggttcccaccaccatcaccatcactag

SEQ ID NO: 1121 - DNA, 426 bp, Artificial Sequence
  Synthetic polymer
caggtgcagctgcaggagtctgggggaggcttggtgcagcctggggggtctctgagactctcctgtgcagcctatggaagcatcttcagtatcaacgccatgggctggtaccgccaggctccagggaaggagcgcgagttggtcgcaggtattactacacaaggtaggataacgtatggaaactccgtgaggggccgattcaccatctccggagacaacgccaagaacacggtatatctgcaaatgaaaagcctgaaacctgaggacacggccgtctattactgtagtgcctggggtgtaaagacggggcctgaatccggtagcggtacgttggaaggccaggggacccaggtcaccgtctcctcagcggccgcatacccgtacgacgttccggactacggttcccaccaccatcaccatcactag

SEQ ID NO: 1122 - DNA, 408 bp, Artificial Sequence
  Synthetic polymer
caggtgcagctgcaggagtctgggggaggcttggtgcagcctggggggtctctgagactctcctgtgcagcctctggaaccagcttcagtatcaatggcatggcctggtaccgccaggctccaggggggcagcgcgagttggtcggaggtattactagtgatggtagcacaggctatgcagactccgtgaagggccgattcaccgtctccagagacaacgccaagaacacggtgtatctgcaaatgaacagactgaaacctgaggacacagccgtctattactgtgggactagtacacctcgtggtgatagctactggggccaggggacccaggtcaccgtctcctcagcggccgcatacccgtacgacgttccggactacggttcccaccaccatcaccatcactag

SEQ ID NO: 1123 - DNA, 408 bp, Artificial Sequence
  Synthetic polymer
caggtgcagctgcaggagtctggaggaggcttggtgcaggctggggggtctctgagactctcctgtgcagcctctggaacgctcttcagtatcaatggcatggcctggtaccgccaggctccagggaagcgccgcgagttggtcggaggtattacgtctgatggtagcacaggctatgcagactccgtgaagggccgattcaccatctccagagacaacgccaagaacacggcgtatctgcaaatgaacagcctgaaacctgaggacacagccgtttattactgtgggactagtacacctcgtggtgatagctactggggccaggggacccaggtcaccgtctcctcagcggccgcatacccgtacgacgttccggactacggttcccaccaccatcaccatcactag

SEQ ID NO: 1124 - DNA, 405 bp, Artificial Sequence
  Synthetic polymer
caggtgcagctgcaggagtctggaggaggcttggcgcagcctggggggtctctacaactctcctgtgcagcctctggaagggccttcagtacgaattccatgggctggtaccgccaggcttcagggaagcagcgcgagttggtcgcggctattactagtcaaggtagaataaccttagccgactccgtgaagggccgattcaccatctccagcgacaacaccaagaacacggtgtttctgcaaatgaacagtctgaaacctgaggacacggccgtctattactgtaatgcctggactacattgggaaccttcgggggccaggggacccaggtcaccgtctcctcagcggccgcatacccgtacgacgttccggactacggttcccaccaccatcaccatcactag

SEQ ID NO: 1125 - DNA, 414 bp, Artificial Sequence
  Synthetic polymer
caggtgcagctgcaggagtctgggggaggcttggtgcagcctggggggtctctgagactctcctgtgcagccattggaaatatcgccagcatcaccgccatgggctggtaccgccaggctccagggaagcagcgcgaattggtcgcagccattaccagtgctagtgcgagtaggacaacctatgcagactccgtgaagggccgattcaccatctccagagacaacgccaagaacacggtgtatctgcaaatgaatagtctgcaacctgaggatacggccgtctattactgtaagggtttccgatctggggcggatgactactggggccaggggacccaggtcaccgtctcctcagcggccgcatacccgtacgacgttccggactacggttcccaccaccatcaccatcactag

SEQ ID NO: 1126 - DNA, 411 bp, Artificial Sequence
  Synthetic polymer
caggtgcagctgcaggagtctgggggaggttgggtgcagcctggggggtctctgagactctcctgtgcagccactggaagcatcgtcagtatcaatgccataggctggtaccgccaggctccagggaagcagcgcgaattggtcgcaagtattactaatcaaggtattagaaattattcaacctccgtgatgggccgattcaccatctccagagacgacgtcaagaacacggtgtctctgcaaatgaacagcctgaaacctgaggactcggccgtctattactgtaaagggtttgcgggttggggtaaagaggactactggggccaggggacccaggtcaccgtctcctcagcggccgcatacccgtacgacgttccggactacggttcccaccaccatcaccatcactag

SEQ ID NO: 1127 - DNA, 411 bp, Artificial Sequence
  Synthetic polymer
caggtgcagctgcaggagtctgggggaggtcgggtgcagcctggggggtctctgagactctcctgtgcagccatcggaagcatcttcgagatcaatagcatagggtggtaccgccaggctccagggaagcagcgcgagttggtcgcagcaattactagtggtggtattacgaactatgcaaactccgtgcagggccgatccaccatctccagagacaacgtcaacaacacggtgtatcttcaaatgaacagcctaaaacctgaggactcggccgtctattactgtaaaggatttacgggttggggtaaagaggactactggggccaggggacccaggtcaccgtctcctcagcggccgcatacccgtacgacgttccggactacggttcccaccaccatcaccatcactag

SEQ ID NO: 1128 - DNA, 438 bp, Artificial Sequence
  Synthetic polymer
caggtgcagctgcaggagtctgggggaggcttggtgcaggctggggggtctctgagactctcctgtgcagcctctggacgcaccttcagtacctatgccatgggctggttccgccaggctccagggaaggagcgtgggcttgttgcagctattagctggagtggtggtagcacatattatgcagactccgtgaagggccgattcaccatcttcagagacaacgccgagaatacggtgtatctgcaaatgaacagcctgaagcctgaggacacggccgtttattactgtgctgcagaggccgaagggagtggccgagagggaaacttttacgaacgtagctggtaccagggacaggggacccaggtcaccgtctcctcagcggccgcatacccgtacgacgttccggactacggttcccaccaccatcaccatcactag

SEQ ID NO: 1129 - DNA, 438 bp, Artificial Sequence
  Synthetic polymer
caggtgcagctgcaggagtctggaggaggatcggtgcaggctgggggctcgctgagactctcctgtgcagcctctggacgcaccttcagtagctatgccatggcctggttccgccaggctccagggatggagcgtgagcttgttgcagctattagctggagtggtggtagcacatattatgcagactccgtgaagggccgattcaccatctccagagacaacgccgagaacacggtgtatctgcaaatgaacagcctgaagcctgaggacacggccgtttattactgtgctgcagaggccgaagggagtggccgagagggaaacttttacgaacgtagctggtaccagggacaggggacccaggtcaccgtctcctcagcggccgcatacccgtacgacgttccggactacggttcccaccaccatcaccatcactag

SEQ ID NO: 1130 - DNA, 438 bp, Artificial Sequence
  Synthetic polymer
caggtgcagctgcaggagtctggaggaggtctggtgcaggctgggggctctctgagactctcctgtgaagcctctggacgcaccttcagtacctatgccatggcctggttccgccaggctccagggaaggagcgtgaccttgtagcagctattagctggagtggtggttccacagagtatcacgactccgtgaagggccgattcactatctccagagacaacaccaagaacacggtgtatctgcaaatgaacagcctgaaagctgaggacacggccgtttattactgtgcagcagaggtcgaagggagtggccgagagggaaacttttacggtgctagctggtacccgggacaggggacccaggtcaccgtctcctcagcggccgcatacccgtacgacgttccggactacggttcccaccaccatcaccatcactag

SEQ ID NO: 1131 - DNA, 417 bp, Artificial Sequence
  Synthetic polymer
caggtgcagctgcaggagtctgggggaggattggtgcaggcagggggctctctgagactctcctgtgcagcctctggacgcaccttcccaggctatgtcatggcctggttccgccagtctccagggcaggagcgtgagtttgccgcagctattaattggcgtggtggagacacatactatgcagactccgtgaagggccgattcaccatctccagagacaacgtcaagaacacggtgtttctgcaaatgaacagcctgaaacctgaggacacggccgtttatttctgtgcagcccggcttactactgaatatgactatgcctactggggccaggggacccaggtcaccgtctcctcagcggccgcatacccgtacgacgttccggactacggttcccaccaccatcaccatcactag

SEQ ID NO: 1132 - DNA, 405 bp, Artificial Sequence
  Synthetic polymer
caggtgcagctgcaggagtctgggggaggcttggtgcagcctggggggtttctgagcctctcctgcgcagccagtggaagcatgcacagtgtcaattccatggcctggtaccgccaggtgccagggaagcagcgcgagttggtcgcggcgattactagtggtggcaggctcgcctatgcaccctccgtgaacggccgattcaccatctccagagactacgccaagaacacgatacatctccaaatgaatagccttgaacctgaggacacagccgtctattactgtgcggcattgaattcagcgaccacatactggggtcaggggacccaggtcaccgtctcctcagcggccgcatacccgtacgacgttccggactacggttcccaccaccatcaccatcactag

SEQ ID NO: 1133 - DNA, 405 bp, Artificial Sequence
  Synthetic polymer
caggtgcagctgcaggagtctgggggaggattggtgcaggctgggggctctctgagactctcctgcgcagcctctggaagcgtcttcagtatcaatgccatgggctggtaccgccaggctccagagaaacaacgcgagttggtcgctgctattactactcagggtagaacaacatatgaagactccgtgaagggccgattcaccatctccagagacggcgcccagaacacggtatacctacaaatggacagcctgaaacccgaggatacggccgtctattattgtaaagcgtggacggctaaggatgactactggggcaaagggacccaggtcaccgtctcctcagcggccgcatacccgtacgacgttccggactacggttcccaccaccatcaccatcactag

SEQ ID NO: 1134 - DNA, 420 bp, Artificial Sequence
  Synthetic polymer
caggtgcagctgcaggagtctgggggaggattggtgcaggctgggggttctctgagagtctcctgtgcagcttctggacgcaccctcagtaactatgccgtaggctggtggcgccaggctccagggaagcagcgtgagtttgtagcagcaattaactggagtagtggtggaatttcgtattcaaactccgcgaagggccgattcgccctctctagagataacgccaagaacacggtgtatctgcaaatggacagcctgaaacctgaggacacggccgtttattactgtgcagcggccagttcggtcttaagtggaactgttgactactggggccaggggacccaggtcaccgtctcctcagcggccgcatacccgtacgacgttccggactacggttcccaccaccatcaccatcactag

SEQ ID NO: 1135 - DNA, 420 bp, Artificial Sequence
  Synthetic polymer
caggtgcagctgcaggagtctggaggaggcttggtgcaggctgggggttctctgagagtctcctgtgcagcttctggacgcaccctcagtaactatgccgtagcctggttccgccaggctccaggaaagcagcgtgagtttgtagcagcgattaactggagtagtggtgggatttcgtattcaaacgccgcgaagggccgattcgccctctctcgagataacgccaagaacacggtgtatctgcaaatggacagcctgaaacctgaggacacggccgtttattactgtgcagcggccagttcgatcttaagtggaactgttgactactggggccaggggacccaggtcaccgtctcctcagcggccgcatacccgtacgacgttccggactacggttcccaccaccatcaccatcactag

SEQ ID NO: 1136 - DNA, 420 bp, Artificial Sequence
  Synthetic polymer
caggtgcagctgcaggagtctggaggaggattggtgcaggctgggggctctctgagactctcctgtgcagcttccggacgcaccctcagtaactatgccgtagcctggttccgccaggctccagggaagcagcgtgagcttgtagctgcgatttggtgggctagtggtggcatatcgtatgcaaactccgcgaagggccgattcgtcctctccagagacaacgccaagaacacggtgtatctgcaaatggacagcctgaaacctgaggacacggccgtttattactgtgcagcggccagttcggtcttaagtggaactgctgactactggggccaggggacccaggtcaccgtctcctcagcggccgcatacccgtacgacgttccggactacggttcccaccaccatcaccatcactag

SEQ ID NO: 1137 - DNA, 408 bp, Artificial Sequence
  Synthetic polymer
caggtgcagctgcaggagtctgggggaggattggttcaggctgggggctctctgagactctcctgtgcagcctctgtaaacatcgacactctcaatagcatggcctggtaccgccaggctccagggaagcagcgcgagttggtcgcaggtattactgggagtggtcaaataacctatgcgaactccgtgaggggccgattcaccgtctcccgggacaacgccaagagcacggtgtatctgcaaatgaacaccctgcaacctgaggacacagccgtctattactgtgcagcctatgaccgtagtagtactccgtactggggccaggggacccaggtcaccgtctcctcagcggccgcatacccgtacgacgttccggactacggttcccaccaccatcaccatcactag

SEQ ID NO: 1138 - DNA, 408 bp, Artificial Sequence
  Synthetic polymer
caggtgcagctgcaggagtctgggggaggattggtgcaggctgggggctctctgagactctcctgtgcagcctctgtaaacatcggcactctcaatagcatggcctggtaccgcgaggctccagggaagcagcgcgagttggtcgcaggtattactgggggtggtcaaataacctatgcgaactccgtgaggggccgattcaccgtctcccgggacatcgccaagagcacggcgtatctgcaaatgaacaccctgaaacctgaggacacagccgtctattactgtgcagcctatgaccgtagtgctactccgtactggggccaggggacccaggtcaccgtctcctcagcggccgcatacccgtacgacgttccggactacggttcccaccaccatcaccatcactag

SEQ ID NO: 1139 - DNA, 408 bp, Artificial Sequence
  Synthetic polymer
caggtgcagctgcaggagtctgggggaggcttagtgcaggctggggggtctctgagactctcctgtgtagcctctgtaaacatcggcagtctcaatagcatggtgtggtaccgccaatctccagggaagcagcgcgagttggtcgcaggtattactgggagtggtcaaataacctatgcgaactccgtgaggggccgattcaccgtctcccgggacatcgccaagagcacggcgtatctgcaaatgaacaccctgaaacctgaggacacagccgtctattactgtgcagcctatgaccgtagtgctactgcgtactggggccaggggacccaggtcaccgtctcctcagcggccgcatacccgtacgacgttccggactacggttcccaccaccatcaccatcactag

SEQ ID NO: 1140 - DNA, 432 bp, Artificial Sequence
  Synthetic polymer
caggtgcagctgcaggagtctgggggaggcttggtgcagcctggggggtctctgagactctcctgtgcagcctctggattcactttcgatgattatgccataggctggttccgccaggccccagggaaggagcatgagggggtctcatgtattagccgtagtgatggtagcacatactatgacgactccgtgaagggccgattcaccatctccagtgacaacgccaagaacacggtgtatctgcaaatgaacagcctgaaacctgaggacacggccgtttattactgtgcagcagaagtcccatctacttactcctgctcaggcttccgcgaggactacaaaggcaaagggacccaggtcaccgtctcctcagcggccgcctacccgtacgacgttccggactacggttcccaccaccatcaccatcactag

SEQ ID NO: 1141 - protein, 135 aa, Artificial Sequence
  Synthetic polymer
  misc_feature (135)..(135): Xaa can be any naturally occurring amino acid
QVQLQESGGGLVQPGGSLRLSCAASGRVFSINAMGWYRQAPGKQRELVAAITNQGATTYADSVKGRFTISRDTAGNTVYLQMNSLRPEDTAVHYCKAFTRTDDYWGQGTQVTVSSAAAYPYDVPDYGSHHHHHHX

SEQ ID NO: 1142 - protein, 135 aa, Artificial Sequence
  Synthetic polymer
  misc_feature (135)..(135): Xaa can be any naturally occurring amino acid
QVQLQESGGGLVQPGGSLRLSCAASGRIFSVNAMGWYRQAPGKQRELVAAITNQGAPTYADSVKGRFTISRDNAGNTVYLQMNSLRPEDTAVYYCKAFTRGDDYWGQGTQVTVSSAAAYPYDVPDYGSHHHHHHX

SEQ ID NO: 1143 - protein, 135 aa, Artificial Sequence
  Synthetic polymer
  misc_feature (135)..(135): Xaa can be any naturally occurring amino acid
QVQLQESGGGLVQPGGSLRLSCAASGRIFDINAMGWYRQAPGKQRELVAAITNGGQTTYADSVKGRFTISRDNAGNTVYLQMNSLRPEDTAVYYCKAFTRSDDYWGQGTQVTVSSAAAYPYDVPDYGSHHHHHHX

SEQ ID NO: 1144 - protein, 135 aa, Artificial Sequence
  Synthetic polymer
  misc_feature (135)..(135): Xaa can be any naturally occurring amino acid
QVQLQESGGGLVQPGGSLRLSCAASGRISSINSMGWYRQAPGNQRELVAAITNGGAKTYADSVKGRFTISTDNAGNTVYLQMDSLRPEDTAVYYCKAFTRRDDYWGQGTQITVSSAAAYPYDVPDYGSHHHHHHX

SEQ ID NO: 1145 - protein, 135 aa, Artificial Sequence
  Synthetic polymer
  misc_feature (135)..(135): Xaa can be any naturally occurring amino acid
QVQLQESGGGLVQPGGSLRLSCAASGRISSINSMGWYRQAPGKQRELVAAITNGGAKTYADSVKGRFTISRDGAGNTVYLQMDNLRPEDTAVYYCKAFTRTYDYWGQGTQVTVSSAAAYPYDVPDYGSHHHHHHX

SEQ ID NO: 1146 - protein, 135 aa, Artificial Sequence
  Synthetic polymer
  misc_feature (135)..(135): Xaa can be any naturally occurring amino acid
QVQLQESGGGLVQPGESLRLSCAASGSIFSINAMGWYRQAPGKQRELVAAITDGGAKTYADSVKGRFTISTDNAGNTVYLQMDSLRPEDTAVYYCKAFTRGNDYWGQGTQVTVSSAAAYPYDVPDYGSHHHHHHX

SEQ ID NO: 1147 - protein, 135 aa, Artificial Sequence
  Synthetic polymer
  misc_feature (135)..(135): Xaa can be any naturally occurring amino acid
QVQLQESGGGLVQPGGSLRLSCAASGGISSINSMGWYRQAPGNQRELVAAITNGGRTVYGDSVKGRFTISRDSAGNTVHLQMDSLRPEDTGVYYCKAFTRGDDYWGQGTQVTVSSAAAYPYDVPDYGSHHHHHHX

SEQ ID NO: 1148 - protein, 135 aa, Artificial Sequence
  Synthetic polymer
  misc_feature (135)..(135): Xaa can be any naturally occurring amino acid
QVQLQESGGGLVQPGGSLRLSCAASGRIGSINSMGWYRQAPGKQREMVAAITNGGATVYADSVKGRFTISRDNAGNTVDLHMNSLRPEDSAVYYCKAFTRGDDYWGQGTQVTVSSAAAYPYDVPDYGSHHHHHHX

SEQ ID NO: 1149 - protein, 136 aa, Artificial Sequence
  Synthetic polymer
  misc_feature (136)..(136): Xaa can be any naturally occurring amino acid
QVQLQESGGGLVQPGGSLRLSCAASGRIGSINSMGWYRQAPGKQREMVAAITNGGATVYADSVKGRFTISRDNAGNTVDLHMNSLRPEDSAVYYCTIWAADYQQYWGQGTQVTVSSAAAYPYDVPDYGSHHHHHHX

SEQ ID NO: 1150 - protein, 136 aa, Artificial Sequence
  Synthetic polymer
  misc_feature (136)..(136): Xaa can be any naturally occurring amino acid
QVQLQESGGGLVQPGGSLRLSCAASGSISSINAMGWYRQAPGNQRELVAAITNQGRVTYADSVKGRFTISRDGAKNTVYLQMNSLKPEDTAVYYCKVFAASGMEYWGKGTQVTVSSAAAYPYDVPDYGSHHHHHHX

SEQ ID NO: 1151 - protein, 136 aa, Artificial Sequence
  Synthetic polymer
  misc_feature (136)..(136): Xaa can be any naturally occurring amino acid
QVQLQESGGGLVQPGGSLRLSCAASGSISSINAMGWYRQAPGKQRELVAAITGQGRTTYADSVKGRFTISRDGAKNTVYLQMNSLKPEDTAVYYCKVFAADGMEYWGKGTQVTVSSAAAYPYDVPDYGSHHHHHHX

SEQ ID NO: 1152 - protein, 137 aa, Artificial Sequence
  Synthetic polymer
  misc_feature (137)..(137): Xaa can be any naturally occurring amino acid
QVQLQESGGGLVQPGGSLRLSCAASGSIVSINSMGWYRQAPGKQRELVAAITDQGRTTYADSVKGRFTISRDDAKNKNTVYLQMNSLKAEDTAVYACKAFGRFDDYWGQGTQVTVSSAAAYPYDVPDYGSHHHHHHX

SEQ ID NO: 1153 - protein, 141 aa, Artificial Sequence
  Synthetic polymer
  misc_feature (141)..(141): Xaa can be any naturally occurring amino acid
QVQLQESGGGLVQPGGSLRLSCAASGSIFSINAMGWYRQAPGKQRELVAAITNQGRLTYADSVKGRFTISRDNAKNTVFLQMDSLKPEDTAVYYCNAKWYDPLVIEYYDNWGQGTQVTVSSAAAYPYDVPDYGSHHHHHHX

SEQ ID NO: 1154 - protein, 133 aa, Artificial Sequence
  Synthetic polymer
  misc_feature (133)..(133): Xaa can be any naturally occurring amino acid
QVQLQESGGGLVQPGGSLRLSCAASGSFFSINAMGWYRQAPGKQRELVAAITNQGRIAYADSVKGRFTISRDNAKNTVYLQMNSLKPEDTAVYYCGRPGWDYWGQGTQVTVSSAAAYPYDVPDYGSHHHHHHX

SEQ ID NO: 1155 - protein, 135 aa, Artificial Sequence
  Synthetic polymer
  misc_feature (135)..(135): Xaa can be any naturally occurring amino acid
QVQLQESGGGLVQAGASLRLSCAASGSIFSINAMGWYRQAPGKQRELVAAITNQGRTTYADSVKGRFTISRDNAKNTVYLQMDSLEPEDTAIYYCKGFSPTGDYWGQGTQVTVSSAAAYPYDVPDYGSHHHHHHX

SEQ ID NO: 1156 - protein, 135 aa, Artificial Sequence
  Synthetic polymer
  misc_feature (135)..(135): Xaa can be any naturally occurring amino acid
QVQLQESGGGLVQAGGSLRLSCAASGSIFSINSMGWYRQAPGKQRELVAAITNGGRTTYADSVKGRFTISRDNAKNTVYLQMDSLKPEDTAVYYCKGFSLTDDYWGQGTQVTVSSAAAYPYDVPDYGSHHHHHHX

SEQ ID NO: 1157 - protein, 134 aa, Artificial Sequence
  Synthetic polymer
  misc_feature (54)..(54): Xaa can be any naturally occurring amino acid
  misc_feature (134)..(134): Xaa can be any naturally occurring amino acid
QVQLQESGGGLVQPGESLRLSCAASGIIFSINAMGWYRQAPGKQRELVAAITNXGRTTYADSVKGRFTISRDNAKNTVTLQMNSLKPEDTAVYYCNAFGSGGGVGQGTQVTVSSAAAYPYDVPDYGSHHHHHHX

SEQ ID NO: 1158 - protein, 135 aa, Artificial Sequence
  Synthetic polymer
  misc_feature (135)..(135): Xaa can be any naturally occurring amino acid
QVQLQESGGGLVQAGGSLRLSCAASGRTLSSYTIGWYRQAPGKQRELVAAITNQGRRTYADSVKGRFTISRDNAKNTVYLQMDSLKSEDTAVYYCKGFSPTDDFWGQGTQVTVSSAAAYPYDVPDYGSHHHHHHX

SEQ ID NO: 1159 - protein, 141 aa, Artificial Sequence
  Synthetic polymer
  misc_feature (141)..(141): Xaa can be any naturally occurring amino acid
QVQLQESGGGLVQPGGSLRLSCLASRSFSSFNAMGWYRQAPGKERELVAAITNGGRIAYGIAVNGRFTISRDNAKNTVYLQMNSLKPEDTAVYYCNAKPTPVYGSTVGDYWGQGTQVTVSSAAAYPYDVPDYGSHHHHHHX

SEQ ID NO: 1160 - protein, 141 aa, Artificial Sequence
  Synthetic polymer
  misc_feature (141)..(141): Xaa can be any naturally occurring amino acid
QVQLQESGGGLVQPGGSLRLSCAASRSFFSFNAMGWYRQAPGKQRELVAAITNGGRIAYGTSVMGRFTISRDNAKNTVYLQMDSLKPEDTAVYYCNAKPAPVYGSTVGDYWGQGTQVTVSSAAAYPYDVPDYGSHHHHHHX

SEQ ID NO: 1161 - protein, 141 aa, Artificial Sequence
  Synthetic polymer
  misc_feature (141)..(141): Xaa can be any naturally occurring amino acid
QVQLQESGGGLVQPGGSLRLSCAVSRNFFSINAMGWYRQAPGKQRELVAAITNGGRIAYGTSVMGRFTISRDDAKNTVDLQMNSLRPEDTAVYYCNAKAIPVYGSTVEDYWGQGTQVTVSSAAAYPYDVPDYGSHHHHHHX

SEQ ID NO: 1162 - protein, 141 aa, Artificial Sequence
  Synthetic polymer
  misc_feature (141)..(141): Xaa can be any naturally occurring amino acid
QVQLQESGGGLVQSGGSLRLSCAASGSVFSINAWGWYRQAPGKQRELVAAITNQGRIAYAPSVNGRFTISRDSAKNTVYLQMNSLKPEDTAVYYCNAKPTPVYGSTVGDYWGQGTQVTVSSAAAYPYDVPDYGSHHHHHHX

SEQ ID NO: 1163 - protein, 141 aa, Artificial Sequence
  Synthetic polymer
  misc_feature (141)..(141): Xaa can be any naturally occurring amino acid
QVQLQESGGGLVQAGGSLTLSCAASGSFSSINAMGYYRQAPGKQRELVAAITNGGRIAYSDSAKGRFTISRDSAKNTMYLQMNSLKPEDTDVYYCNAKASPVYGSTVEDYWGQGTQVTVSSAAAYPYDVPDYGSHHHHHHX

SEQ ID NO: 1164 - protein, 141 aa, Artificial Sequence
  Synthetic polymer
  misc_feature (141)..(141): Xaa can be any naturally occurring amino acid
QVQLQESGGGLVQPGGSLRLSCTASGSFFSINAMGWYRQAPGNQRELVAAITNGGRIAYTDSVKGRFTISNDNAKNTVYLQMNSLKPEDTDVYYCNAKAIPIYGSTAEDYWGQGTQVTVSSAAAYPYDVPDYGSHHHHHHX

SEQ ID NO: 1165 - protein, 136 aa, Artificial Sequence
  Synthetic polymer
  misc_feature (136)..(136): Xaa can be any naturally occurring amino acid
QVQLQESGGGLVQTGGSLRLSCAASGSIFSFNAMGWYRQAPGKQRELVAAITDGGRLTYADSAKGRFTISRENTRNTVHLQMSSLKAEDTADYYCTIWTRDRQQYWGQGTQVTVSSAAAYPYDVPDYGSHHHHHHX

SEQ ID NO: 1166 - protein, 136 aa, Artificial Sequence
  Synthetic polymer
  misc_feature (136)..(136): Xaa can be any naturally occurring amino acid
QVQLQESGGGLVQPGGSLKLSCAASGSIFSFNAMGWYRQAPGKQRELVAAITDGGRLTYADSAKNRFTISRENTRNTVHLQMSSLKAEDTAVYYCTIWTKDRQQYWGQGTQVTVSSAAAYPYDVPDYGSHHHHHHX

SEQ ID NO: 1167 - protein, 136 aa, Artificial Sequence
  Synthetic polymer
  misc_feature (136)..(136): Xaa can be any naturally occurring amino acid
QVQLQESGGGLVETGGSLRLSCAASGSIFSINAMGWYRQAPGKQRELVAAITDQGRLAYADSAKGRFTISRENARNTLHLQMSSLKAEDTAVYYCTIWDRDRQQYWGQGTQVTVSSAAAYPYDVPDYGSHHHHHHX

SEQ ID NO: 1168 - protein, 136 aa, Artificial Sequence
  Synthetic polymer
  misc_feature (136)..(136): Xaa can be any naturally occurring amino acid
QVQLQESGGGLVQAGESLRLSCAASVSIFRSYFMGWYRQAPGKQRELVAAITDGGRLAYADSAKGRFTISREDTRNTVHLQMSSLKAEDTAVYYCTIWTTDRQQYWGQGTQVTVSSAAAYPYDVPDYGSHHHHHHX

SEQ ID NO: 1169 - protein, 136 aa, Artificial Sequence
  Synthetic polymer
  misc_feature (136)..(136): Xaa can be any naturally occurring amino acid
QVQLQESGGGLVQTGGSLRLSCAASGSIFSINSMGWYRQAPGKQRELVAAITSQGRSTYADSAKGRFTISLGNARNTVNLQMSSLKTEDTAVYYCTIWARDRQQYWGQGTQVTVSSAAAYPYDVPDYGSHHHHHHX

SEQ ID NO: 1170 - protein, 141 aa, Artificial Sequence
  Synthetic polymer
  misc_feature (141)..(141): Xaa can be any naturally occurring amino acid
QVQLQESGGGLVQPGGSLRLSCAASGRFFRVNAMGWYRQVPGKQRELVAAITNGGQIAYADSVKGRFTISRDSAKNTVYLQMNSLKSEDTDVYYCNAKAAATHLSTVADYWGQGTQVTVSSAAAYPYDVPDYGSHHHHHHX

SEQ ID NO: 1171 - protein, 141 aa, Artificial Sequence
  Synthetic polymer
  misc_feature (141)..(141): Xaa can be any naturally occurring amino acid
QVQLQESGGGLVQPGGSLRLSCAASGRFFRVNAMGWYRQAPGKQRELVAAITNGGQIVYADSVKGRFTISRDSAKNTVYLQMNSLKSEDTAVYYCNAKAAASYVSTVADYWGQGTQVTVSSAAAYPYDVPDYGSHHHHHHX

SEQ ID NO: 1172 - protein, 136 aa, Artificial Sequence
  Synthetic polymer
  misc_feature (136)..(136): Xaa can be any naturally occurring amino acid
QVQLQESGGGLVQPGGSPRLSCAASGRFFRVNAMGWYRQAPGKQRELVAAITNGGQTAYADSVKGRFTISRDSAKNTVYLQMNSLKSEDTAVYYCKVFAADGMEYWGKGTQVTVSSAAAYPYDVPDYGSHHHHHHX

SEQ ID NO: 1173 - protein, 136 aa, Artificial Sequence
  Synthetic polymer
  misc_feature (136)..(136): Xaa can be any naturally occurring amino acid
QVQLQESGGGLVQPGGSLRLSCAASGRFFRVNAMGWYRQAPGKQRELVAAITNGGQTAYADSVKGRFTISKESARNTVHLQMSSLKPEDTAVYYCTIWAADYQQYWGQGTQVTVSSAAAYPYDVPDYGSHHHHHHX

SEQ ID NO: 1174 - protein, 136 aa, Artificial Sequence
  Synthetic polymer
  misc_feature (136)..(136): Xaa can be any naturally occurring amino acid
QVQLQESGGGLVQTGGSLRLSCAASGSIFNINSMGWYRQAPGKQRELVAAITVGGRLAYADSAKGRFTISKESARNTVHLQMSSLKPEDTAVYYCTIWAADYQQYWGQGTQVTVSSAAAYPYDVPDYGSHHHHHHX

SEQ ID NO: 1175 - protein, 136 aa, Artificial Sequence
  Synthetic polymer
  misc_feature (136)..(136): Xaa can be any naturally occurring amino acid
QVQLQESGGGLVQAGESLRLSCAASGSSDSINAMGWYRQAPGKQRELVAAITSGGRSTYIDSAKGRATISRDNARNTAYLQMSSLKAEDTAVYYCTIWNRDRQQYWGQGTQVTVSSAAAYPYDVPDYGSHHHHHHX

SEQ ID NO: 1176 - protein, 138 aa, Artificial Sequence
  Synthetic polymer
  misc_feature (138)..(138): Xaa can be any naturally occurring amino acid
QVQLQESGGGLVQPGGSLRLSCAAIGNIASITAMGWYRQAPGKQRELVAAITSASASRTTYADSVKGRFTISRDNAKNTVYLQMNSLQPEDTAVYYCKGFRSGADDYWGQGTQVTVSSAAAYPYDVPDYGSHHHHHHX

SEQ ID NO: 1177 - protein, 135 aa, Artificial Sequence
  Synthetic polymer
  misc_feature (135)..(135): Xaa can be any naturally occurring amino acid
QVQLQESGGGLVQPGGSLRLSCAASGSIFSIAAMGWYRQAPGKQRELVAAITSGGRRAYADSVKGRFTISRDNDENTVALQMNSLKPEDTDVYYCNAKADHNDYWGQGTQITVSSAAAYPYDVPDYGSHHHHHHX

SEQ ID NO: 1178 - protein, 135 aa, Artificial Sequence
  Synthetic polymer
  misc_feature (135)..(135): Xaa can be any naturally occurring amino acid
QVQLQESGGGLVRAGGSLRLSCAASGSIFSIDAMGWYRPAHGEQRELVAAITTGGRTTYVDSVKGRFTISRDNAKNTVYLQMNSLKPEDTAVYFCKAFTRDEDYWGQGTQVTVSSAAAYPYDVPDYGSHHHHHHX

SEQ ID NO: 1179 - protein, 135 aa, Artificial Sequence
  Synthetic polymer
  misc_feature (135)..(135): Xaa can be any naturally occurring amino acid
QVQLQESGGGLVQAGGSLRLSCAASGSIFSINAMGWYRPALGEQRELVAAITTGGRTTYVDSVKGRFSISRDNAKNTVYLQMNSLKPEDTAVYFCKAFTRDEDFWGQGTQVTVSSAAAYPYDVPDYGSHHHHHHX

SEQ ID NO: 1180 - protein, 135 aa, Artificial Sequence
  Synthetic polymer
  misc_feature (135)..(135): Xaa can be any naturally occurring amino acid
QVQLQESGGGLVQAGGSLRLSCAASGSILSINSMGWYRPALGNQRELVAAITNDGRTTYVDSVKGRFTISRDNAKNTVYLQMNSLKPEDTAVYWCKAFTRDKDYWGQGTQVTVSSAAAYPYDVPDYGSHHHHHHX

SEQ ID NO: 1181 - protein, 135 aa, Artificial Sequence
  Synthetic polymer
  misc_feature (135)..(135): Xaa can be any naturally occurring amino acid
QVQLQESGGGLVQAGGSLRLSCAATGDISSINAMGWHRPARGNERELVAAITNGGRTTYVDSVKGRFTISRDNAKNTVYLQMNSLKPEDTAVYFCKAYTRDEDYWGQGTQVTVSSAAAYPYDVPDYGSHHHHHHX

SEQ ID NO: 1182 - protein, 135 aa, Artificial Sequence
  Synthetic polymer
  misc_feature (135)..(135): Xaa can be any naturally occurring amino acid
QVQLQESGGGLVQAGGSLRLSCAASGSIDSINAMGWYRPALGEQRELVAAITTGGRTAYVDSVKGRFTISRDAAKNTVYLQMNSLKPEDTAVYSCKAFTRDTDYWGQGTQVTVSSAAAYPYDVPDYGSHHHHHHX

SEQ ID NO: 1183 - protein, 135 aa, Artificial Sequence
  Synthetic polymer
  misc_feature (135)..(135): Xaa can be any naturally occurring amino acid
QVQLQESGGGLVQAGGSLRLSCAASGSIIGINSMGYYRTAPGKQRELVAAITSGGRTTYVDSVKGRFTISRDNAKNTVYLQMNSLKPEDTAVYFCKAFTRDEDYWGQGTQVTVSSAAAYPYDVPDYGSHHHHHHX

SEQ ID NO: 1184 - protein, 137 aa, Artificial Sequence
  Synthetic polymer
  misc_feature (137)..(137): Xaa can be any naturally occurring amino acid
QVQLQESGGGLVQTGESLSLSCAVASGSIISINSMGWYRQAPEKQRELVAAITVDGRLAYADSAKHRFTISKESARNTVHLHMSSLKPEDTAVYYCTIWVRDGQQYWGQGTQVTVSSAAAYPYDVPDYGSHHHHHHX

SEQ ID NO: 1185 - protein, 135 aa, Artificial Sequence
  Synthetic polymer
  misc_feature (135)..(135): Xaa can be any naturally occurring amino acid
QVQLQESGGGLVQAGGSLRLSCAASGSVFSINAMGWYRQAPEKQRELVAAITTQGRTTYEDSVKGRFTISRDGAQNTVYLQMDSLKPEDTAVYYCKAWTAKDDYWGKGTQVTVSSAAAYPYDVPDYGSHHHHHHX

SEQ ID NO: 1186 - protein, 136 aa, Artificial Sequence
  Synthetic polymer
  misc_feature (108)..(108): Xaa can be any naturally occurring amino acid
  misc_feature (136)..(136): Xaa can be any naturally occurring amino acid
QVQLQESGGGLVQTGGSLRLSCAASVSISSINSMGWYRQAPGKERELVAAVTVGGRYAYADSAKNRFTISRDDAQNTVHLQMSSLRAEDTAVYYCTIWDRDRQQYWGXGTQVTVSSAAAYPYDVPDYGSHHHHHHX

SEQ ID NO: 1187 - protein, 135 aa, Artificial Sequence
  Synthetic polymer
  misc_feature (135)..(135): Xaa can be any naturally occurring amino acid
QVQLQESGGGLVQAGGSLRLSCAASGSITSINAMGWYRQAPGKQRELVAAITSGGRLSYADSVKGRFTISRDNAESTVALQMNSLKPEDTAVYSCAAFQSSGIDWGQGTQVTVSSAAAYPYDVPDYGSHHHHHHX

SEQ ID NO: 1188 - protein, 135 aa, Artificial Sequence
  Synthetic polymer
  misc_feature (135)..(135): Xaa can be any naturally occurring amino acid
QVQLQESGGGLVQAGESLRLSCVVSGRTFSINAMGWYRQAPGKQRELVAAITNQGRLSYVDSVKGRFTISRDNAANTVYLQMNSLKPEDTAVYYCAAFQSSGIDWGQGTQVTVSSAAAYPYDVPDYGSHHHHHHX

SEQ ID NO: 1189 - protein, 142 aa, Artificial Sequence
  Synthetic polymer
  misc_feature (142)..(142): Xaa can be any naturally occurring amino acid
QVQLQESGGGLVQPGGSLRLSCAAYGSIFSINAMGWYRQAPGKERELVAGITTQGRITYGNSVRGRFTISGDNAKNTVYLQMKSLKPEDTAVYYCSAWGVKTGPESGSGTLEGQGTQVTVSSAAAYPYDVPDYGSHHHHHHX

SEQ ID NO: 1190 - protein, 137 aa, Artificial Sequence
  Synthetic polymer
  misc_feature (137)..(137): Xaa can be any naturally occurring amino acid
QVQLQESGGGWVQPGGSLRLSCAATGSIVSINAIGWYRQAPGKQRELVASITNQGIRNYSTSVMGRFTISRDDVKNTVSLQMNSLKPEDSAVYYCKGFAGWGKEDYWGQGTQVTVSSAAAYPYDVPDYGSHHHHHHX

SEQ ID NO: 1191 - protein, 146 aa, Artificial Sequence
  Synthetic polymer
  misc_feature (146)..(146): Xaa can be any naturally occurring amino acid
QVQLQESGGGLVQAGGSLRLSCAASGRTFSTYAMGWFRQAPGKERGLVAAISWSGGSTYYADSVKGRFTIFRDNAENTVYLQMNSLKPEDTAVYYCAAEAEGSGREGNFYERSWYQGQGTQVTVSSAAAYPYDVPDYGSHHHHHHX

SEQ ID NO: 1192 - protein, 146 aa, Artificial Sequence
  Synthetic polymer
  misc_feature (146)..(146): Xaa can be any naturally occurring amino acid
QVQLQESGGGSVQAGGSLRLSCAASGRTFSSYAMAWFRQAPGMERELVAAISWSGGSTYYADSVKGRFTISRDNAENTVYLQMNSLKPEDTAVYYCAAEAEGSGREGNFYERSWYQGQGTQVTVSSAAAYPYDVPDYGSHHHHHHX

SEQ ID NO: 1193 - protein, 146 aa, Artificial Sequence
  Synthetic polymer
  misc_feature (146)..(146): Xaa can be any naturally occurring amino acid
QVQLQESGGGLVQAGGSLRLSCEASGRTFSTYAMAWFRQAPGKERDLVAAISWSGGSTEYHDSVKGRFTISRDNTKNTVYLQMNSLKAEDTAVYYCAAEVEGSGREGNFYGASWYPGQGTQVTVSSAAAYPYDVPDYGSHHHHHHX

SEQ ID NO: 1194 - protein, 136 aa, Artificial Sequence
  Synthetic polymer
  misc_feature (136)..(136): Xaa can be any naturally occurring amino acid
QVQLQESGGGLVQPGGSLRLSCAASGTSFSINGMAWYRQAPGGQRELVGGITSDGSTGYADSVKGRFTVSRDNAKNTVYLQMNRLKPEDTAVYYCGTSTPRGDSYWGQGTQVTVSSAAAYPYDVPDYGSHHHHHHX

SEQ ID NO: 1195 - protein, 136 aa, Artificial Sequence
  Synthetic polymer
  misc_feature (136)..(136): Xaa can be any naturally occurring amino acid
QVQLQESGGGLVQAGGSLRLSCAASGTLFSINGMAWYRQAPGKRRELVGGITSDGSTGYADSVKGRFTISRDNAKNTAYLQMNSLKPEDTAVYYCGTSTPRGDSYWGQGTQVTVSSAAAYPYDVPDYGSHHHHHHX

SEQ ID NO: 1196 - protein, 139 aa, Artificial Sequence
  Synthetic polymer
  misc_feature (139)..(139): Xaa can be any naturally occurring amino acid
QVQLQESGGGLVQAGGSLRLSCAASGRTFPGYVMAWFRQSPGQEREFAAAINWRGGDTYYADSVKGRFTISRDNVKNTVFLQMNSLKPEDTAVYFCAARLTTEYDYAYWGQGTQVTVSSAAAYPYDVPDYGSHHHHHHX

SEQ ID NO: 1197 - protein, 137 aa, Artificial Sequence
  Synthetic polymer
  misc_feature (137)..(137): Xaa can be any naturally occurring amino acid
QVQLQESGGGRVQPGGSLRLSCAAIGSIFEINSIGWYRQAPGKQRELVAAITSGGITNYANSVQGRSTISRDNVNNTVYLQMNSLKPEDSAVYYCKGFTGWGKEDYWGQGTQVTVSSAAAYPYDVPDYGSHHHHHHX

SEQ ID NO: 1198 - protein, 144 aa, Artificial Sequence
  Synthetic polymer
  misc_feature (144)..(144): Xaa can be any naturally occurring amino acid
QVQLQESGGGLVQPGGSLRLSCAASGFTFDDYAIGWFRQAPGKEHEGVSCISRSDGSTYYDDSVKGRFTISSDNAKNTVYLQMNSLKPEDTAVYYCAAEVPSTYSCSGFREDYKGKGTQVTVSSAAAYPYDVPDYGSHHHHHHX

SEQ ID NO: 1199 - protein, 135 aa, Artificial Sequence
  Synthetic polymer
  misc_feature (135)..(135): Xaa can be any naturally occurring amino acid
QVQLQESGGGLAQPGGSLQLSCAASGRAFSTNSMGWYRQASGKQRELVAAITSQGRITLADSVKGRFTISSDNTKNTVFLQMNSLKPEDTAVYYCNAWTTLGTFGGQGTQVTVSSAAAYPYDVPDYGSHHHHHHX

SEQ ID NO: 1200 - protein, 135 aa, Artificial Sequence
  Synthetic polymer
  misc_feature (135)..(135): Xaa can be any naturally occurring amino acid
QVQLQESGGGLVQPGGFLSLSCAASGSMHSVNSMAWYRQVPGKQRELVAAITSGGRLAYAPSVNGRFTISRDYAKNTIHLQMNSLEPEDTAVYYCAALNSATTYWGQGTQVTVSSAAAYPYDVPDYGSHHHHHHX

SEQ ID NO: 1201 - protein, 136 aa, Artificial Sequence
  Synthetic polymer
  misc_feature (136)..(136): Xaa can be any naturally occurring amino acid
QVQLQESGGGLVQAGGSLRLSCAASVNIDTLNSMAWYRQAPGKQRELVAGITGSGQITYANSVRGRFTVSRDNAKSTVYLQMNTLQPEDTAVYYCAAYDRSSTPYWGQGTQVTVSSAAAYPYDVPDYGSHHHHHHX

SEQ ID NO: 1202 - protein, 136 aa, Artificial Sequence
  Synthetic polymer
  misc_feature (136)..(136): Xaa can be any naturally occurring amino acid
QVQLQESGGGLVQAGGSLRLSCAASVNIGTLNSMAWYREAPGKQRELVAGITGGGQITYANSVRGRFTVSRDIAKSTAYLQMNTLKPEDTAVYYCAAYDRSATPYWGQGTQVTVSSAAAYPYDVPDYGSHHHHHHX

SEQ ID NO: 1203 - protein, 136 aa, Artificial Sequence
  Synthetic polymer
  misc_feature (136)..(136): Xaa can be any naturally occurring amino acid
QVQLQESGGGLVQAGGSLRLSCVASVNIGSLNSMVWYRQSPGKQRELVAGITGSGQITYANSVRGRFTVSRDIAKSTAYLQMNTLKPEDTAVYYCAAYDRSATAYWGQGTQVTVSSAAAYPYDVPDYGSHHHHHHX

SEQ ID NO: 1204 - protein, 140 aa, Artificial Sequence
  Synthetic polymer
  misc_feature (140)..(140): Xaa can be any naturally occurring amino acid
QVQLQESGGGLVQAGGSLRVSCAASGRTLSNYAVGWWRQAPGKQREFVAAINWSSGGISYSNSAKGRFALSRDNAKNTVYLQMDSLKPEDTAVYYCAAASSVLSGTVDYWGQGTQVTVSSAAAYPYDVPDYGSHHHHHHX

SEQ ID NO: 1205 - protein, 140 aa, Artificial Sequence
  Synthetic polymer
  misc_feature (140)..(140): Xaa can be any naturally occurring amino acid
QVQLQESGGGLVQAGGSLRVSCAASGRTLSNYAVAWFRQAPGKQREFVAAINWSSGGISYSNAAKGRFALSRDNAKNTVYLQMDSLKPEDTAVYYCAAASSILSGTVDYWGQGTQVTVSSAAAYPYDVPDYGSHHHHHHX

SEQ ID NO: 1206 - protein, 140 aa, Artificial Sequence
  Synthetic polymer
  misc_feature (140)..(140): Xaa can be any naturally occurring amino acid
QVQLQESGGGLVQAGGSLRLSCAASGRTLSNYAVAWFRQAPGKQRELVAAIWWASGGISYANSAKGRFVLSRDNAKNTVYLQMDSLKPEDTAVYYCAAASSVLSGTADYWGQGTQVTVSSAAAYPYDVPDYGSHHHHHHX

What is claimed is:

1. A C-type lectin domain family 9 member A (Clec9A) binding agent comprising a recombinant heavy-chain-only antibody (VHH) comprising three complementarity determining regions (CDR1, CDR2, and CDR3), wherein:
CDR1 is the amino acid sequence of SEQ ID NO: 51;
CDR2 is the amino acid sequence of SEQ ID NO: 136; and CDR3 is the amino acid sequence of SEQ ID NO: 202.

2. The Clec9A binding agent of claim 1, wherein the VHH is a humanized VHH.

3. The Clec9A binding agent of claim 2, comprising an amino acid sequence having at least 98% identity to the amino acid sequence of any one of SEQ ID NO: 332-336; and wherein the CDR1 of the VHH is SEQ ID NO: 51, the CDR2 of the VHH is SEQ ID NO:136 and the CDR3 of the VHH is SEQ ID NO:202.

4. The Clec9A binding agent of claim 3, wherein the amino acid sequence is selected from SEQ ID NO: 332-336.

5. A recombinant nucleic acid composition comprising an isolated Polynucleotide encoding the Clec9A binding agent of claim 1.

6. An isolated host cell comprising the nucleic acid of claim 5.

7. A chimeric protein comprising:
(a) the Clec9A binding agent of claim 1; and
(b) a mutated human IFN-α2 comprising one or more mutations at positions R120, M148, R149, and L153 relative to SEQ ID NO: 337 or 338; and
wherein the Clec9A binding agent and the mutated human IFN-α2 are optionally connected with one or more linkers.

8. A chimeric protein comprising:
(a) the Clec9A binding agent of claim 1; and
(b) a mutated human IFN-β comprising one or more mutations at positions W22, R27, L32, R35, V148, L151, R152, and Y155 relative to SEQ ID NO: 339; and
wherein the Clec9A binding agent and the mutated human IFN-β are optionally connected with one or more linkers.

* * * * *